United States Patent 7,842,800 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 2

SEQ ID NO: 38277 - RNA, 19 nt, Homo sapiens
uacauaaaguaugugcaua

SEQ ID NO: 38278 - RNA, 18 nt, Homo sapiens
cuccacuuggacaugggc

SEQ ID NO: 38279 - RNA, 14 nt, Homo sapiens
acacuaaaacaccu

SEQ ID NO: 38280 - RNA, 19 nt, Homo sapiens
cuuuaaaacuuauccucca

SEQ ID NO: 38281 - RNA, 21 nt, Homo sapiens
gaaacuccacauccuguggga

SEQ ID NO: 38282 - RNA, 12 nt, Homo sapiens
gcggaccuuccc

SEQ ID NO: 38283 - RNA, 22 nt, Homo sapiens
cucuaucauuaaaguucuagug

SEQ ID NO: 38284 - RNA, 19 nt, Homo sapiens
gcauccuagucucuaucau

SEQ ID NO: 38285 - RNA, 18 nt, Homo sapiens
gaagagccggagccucca

SEQ ID NO: 38286 - RNA, 10 nt, Homo sapiens
ggacaugggc

SEQ ID NO: 38287 - RNA, 20 nt, Homo sapiens
ugcauucugagguaaccuca

SEQ ID NO: 38288 - RNA, 16 nt, Homo sapiens
ugagccuuuguugcua

SEQ ID NO: 38289 - RNA, 18 nt, Homo sapiens
cugccuccccagcucuau

SEQ ID NO: 38290 - RNA, 13 nt, Homo sapiens
uuguucuugugaa

SEQ ID NO: 38291 - RNA, 17 nt, Homo sapiens
caguaugaaaaugucau

SEQ ID NO: 38292 - RNA, 21 nt, Homo sapiens
ugagcuaggggggucagccag

SEQ ID NO: 38293 - RNA, 16 nt, Homo sapiens
ggaacaugagccuuug

SEQ ID NO: 38294 - RNA, 12 nt, Homo sapiens
ugagguaaccuc

SEQ ID NO: 38295 - RNA, 13 nt, Homo sapiens
gccgacggagccg

SEQ ID NO: 38296 - RNA, 20 nt, Homo sapiens
aacugcagcgaguacuuccc

SEQ ID NO: 38297 - RNA, 17 nt, Homo sapiens
aauucacuccacuugga

SEQ ID NO: 38298 - RNA, 19 nt, Homo sapiens
cugagacacaugggugcua

SEQ ID NO: 38299 - RNA, 18 nt, Homo sapiens
auggcaggaggcauccaa

SEQ ID NO: 38300 - RNA, 16 nt, Homo sapiens
ugcagccccugggacc

SEQ ID NO: 38301 - RNA, 23 nt, Homo sapiens
uucgcgcgccuccgcuacuucca

SEQ ID NO: 38302 - RNA, 20 nt, Homo sapiens
uucccagcuagaauucacuc

SEQ ID NO: 38303 - RNA, 17 nt, Homo sapiens
gccugagcggaccuucc

SEQ ID NO: 38304 - RNA, 23 nt, Homo sapiens
agguaccuucucaccugugagac

SEQ ID NO: 38305 - RNA, 16 nt, Homo sapiens
uucugagguaaccuca

SEQ ID NO: 38306 - RNA, 15 nt, Homo sapiens
auaaaguaugugcau

SEQ ID NO: 38307 - RNA, 18 nt, Homo sapiens
cuaucauuaaaguucuag

SEQ ID NO: 38308 - RNA, 13 nt, Homo sapiens
uuccucgccacgc

SEQ ID NO: 38309 - RNA, 16 nt, Homo sapiens
uuaaaguucuagugac

SEQ ID NO: 38310 - RNA, 19 nt, Homo sapiens
caaagaugaucaguaugaa

SEQ ID NO: 38311 - RNA, 12 nt, Homo sapiens
uguucuugugaa

SEQ ID NO: 38312 - RNA, 21 nt, Homo sapiens
uagaauucacuccacuuggac

SEQ ID NO: 38313 - RNA, 19 nt, Homo sapiens
auaaaacuuuuccaaugac

SEQ ID NO: 38314 - RNA, 16 nt, Homo sapiens
cauaaaguaugugcau

SEQ ID NO: 38315 - RNA, 15 nt, Homo sapiens
uaaaguucuagugac

SEQ ID NO: 38316 - RNA, 19 nt, Homo sapiens
uaaaacuaggugcugcagc

SEQ ID NO: 38317 - RNA, 17 nt, Homo sapiens
uugagcuagggggguca

SEQ ID NO: 38318 - RNA, 14 nt, Homo sapiens
accugugagaccaa

SEQ ID NO: 38319 - RNA, 12 nt, Homo sapiens
aaaaaaacguau

SEQ ID NO: 38320 - RNA, 23 nt, Homo sapiens
cuaguuguaauuuuuuuguggga

SEQ ID NO: 38321 - RNA, 14 nt, Homo sapiens
cagaccgggguucc

SEQ ID NO: 38322 - RNA, 21 nt, Homo sapiens
ccuggcaaagaugaucaguau

SEQ ID NO: 38323 - RNA, 20 nt, Homo sapiens
caguuauuuuuaaacuguaa

SEQ ID NO: 38324 - RNA, 15 nt, Homo sapiens
uaaagcuuugugcag

SEQ ID NO: 38325 - RNA, 13 nt, Homo sapiens
ugagacacauggg

SEQ ID NO: 38326 - RNA, 12 nt, Homo sapiens
uuaucaguccaa

SEQ ID NO: 38327 - RNA, 19 nt, Homo sapiens
uacaaugcauucugaggua

SEQ ID NO: 38328 - RNA, 12 nt, Homo sapiens
acuccacauccu

SEQ ID NO: 38329 - RNA, 18 nt, Homo sapiens
agagccggagccuccagc

SEQ ID NO: 38330 - RNA, 20 nt, Homo sapiens
acuccacuuggacaugggcc

SEQ ID NO: 38331 - RNA, 17 nt, Homo sapiens
cuuccgcauccuagucu

SEQ ID NO: 38332 - RNA, 19 nt, Homo sapiens
aacuauaaaacuaggugcu

SEQ ID NO: 38333 - RNA, 11 nt, Homo sapiens
caaagugugac

SEQ ID NO: 38334 - RNA, 19 nt, Homo sapiens
aacccaaagugugacucau

SEQ ID NO: 38335 - RNA, 16 nt, Homo sapiens
aggagcucccaggagg

SEQ ID NO: 38336 - RNA, 15 nt, Homo sapiens
ccuccgcuacuucca

SEQ ID NO: 38337 - RNA, 17 nt, Homo sapiens
uaaagguccuggcaaag

SEQ ID NO: 38338 - RNA, 15 nt, Homo sapiens
cugccugcccugaaa

SEQ ID NO: 38339 - RNA, 16 nt, Homo sapiens
aucuucuuucaugaag

SEQ ID NO: 38340 - RNA, 20 nt, Homo sapiens
cuguaaagcuuugugcagau

SEQ ID NO: 38341 - RNA, 17 nt, Homo sapiens
ccauuuuugaaaccaaa

SEQ ID NO: 38342 - RNA, 16 nt, Homo sapiens
caugaauaucaguuau

SEQ ID NO: 38343 - RNA, 18 nt, Homo sapiens
cugacacuaaaacaccuc

SEQ ID NO: 38344 - RNA, 14 nt, Homo sapiens
cagauaccaugaug

SEQ ID NO: 38345 - RNA, 15 nt, Homo sapiens
ucauuaaaguucuag

SEQ ID NO: 38346 - RNA, 15 nt, Homo sapiens
cagccccugggacca

SEQ ID NO: 38347 - RNA, 12 nt, Homo sapiens
caucuucuuuca

SEQ ID NO: 38348 - RNA, 21 nt, Homo sapiens
aaccagagccugaguguugcc

SEQ ID NO: 38349 - RNA, 20 nt, Homo sapiens
cccagaucaagccugccuca

SEQ ID NO: 38350 - RNA, 13 nt, Homo sapiens
acuaggugcugca

SEQ ID NO: 38351 - RNA, 16 nt, Homo sapiens
uagccagguaccuucu

SEQ ID NO: 38352 - RNA, 17 nt, Homo sapiens
gaauucacuccacuugg

SEQ ID NO: 38353 - RNA, 16 nt, Homo sapiens
aaagcuuugugcagau

SEQ ID NO: 38354 - RNA, 16 nt, Homo sapiens
aacuuuuccaaugaca

SEQ ID NO: 38355 - RNA, 21 nt, Homo sapiens
ucgauccccugucacgugugg

SEQ ID NO: 38356 - RNA, 23 nt, Homo sapiens
uaaaaaaaaaacguauugcauuu

SEQ ID NO: 38357 - RNA, 13 nt, Homo sapiens
aguaugugcauau

SEQ ID NO: 38358 - RNA, 19 nt, Homo sapiens
cccuucuuacaaugcauuc

SEQ ID NO: 38359 - RNA, 13 nt, Homo sapiens
uuuauuauauaua

SEQ ID NO: 38360 - RNA, 19 nt, Homo sapiens
auauuuuauuauagucacu

SEQ ID NO: 38361 - RNA, 17 nt, Homo sapiens
uuugugggaaauccaca

SEQ ID NO: 38362 - RNA, 17 nt, Homo sapiens
guaaagcuuugugcaga

SEQ ID NO: 38363 - RNA, 20 nt, Homo sapiens
ccgcagggugaacugcagcg

SEQ ID NO: 38364 - RNA, 15 nt, Homo sapiens
uaaaguaugugcaua

SEQ ID NO: 38365 - RNA, 17 nt, Homo sapiens
ccaggcacccccagaau

SEQ ID NO: 38366 - RNA, 15 nt, Homo sapiens
uacauaaaguaugug

SEQ ID NO: 38367 - RNA, 21 nt, Homo sapiens
gcccugaaagucccagaucaa

SEQ ID NO: 38368 - RNA, 14 nt, Homo sapiens
gaacaugagccuuu

SEQ ID NO: 38369 - RNA, 14 nt, Homo sapiens
cgauccccugucac

SEQ ID NO: 38370 - RNA, 15 nt, Homo sapiens
cccagcuagaauuca

SEQ ID NO: 38371 - RNA, 11 nt, Homo sapiens
uaccuucucac

SEQ ID NO: 38372 - RNA, 19 nt, Homo sapiens
uggcaaagaugaucaguau

SEQ ID NO: 38373 - RNA, 13 nt, Homo sapiens
augaaaaugucau

SEQ ID NO: 38374 - RNA, 23 nt, Homo sapiens
agguccuggcaaagaugaucagu

SEQ ID NO: 38375 - RNA, 17 nt, Homo sapiens
ucauuaaaguucuagug

SEQ ID NO: 38376 - RNA, 17 nt, Homo sapiens
cagaucaagccugccuc

SEQ ID NO: 38377 - RNA, 13 nt, Homo sapiens
aauucacuccacu

SEQ ID NO: 38378 - RNA, 20 nt, Homo sapiens
gugagaccaaauugagcuag

SEQ ID NO: 38379 - RNA, 20 nt, Homo sapiens
aaacuuauccuccaugaaua

SEQ ID NO: 38380 - RNA, 19 nt, Homo sapiens
gccugcucgcccacuuccu

SEQ ID NO: 38381 - RNA, 22 nt, Homo sapiens
cccaacuauaaaacuaggugcu

SEQ ID NO: 38382 - RNA, 16 nt, Homo sapiens
ugagguaccagccuug

SEQ ID NO: 38383 - RNA, 11 nt, Homo sapiens
cgcaggaccau

SEQ ID NO: 38384 - RNA, 21 nt, Homo sapiens
uguuguuuuaggaauacauaa

SEQ ID NO: 38385 - RNA, 16 nt, Homo sapiens
acaccucagcugccuc

SEQ ID NO: 38386 - RNA, 22 nt, Homo sapiens
caggauggcaggaggcauccaa

SEQ ID NO: 38387 - RNA, 23 nt, Homo sapiens
ggaacaugagccuuuguugcuau

SEQ ID NO: 38388 - RNA, 23 nt, Homo sapiens
agaagagccggagccuccagcug

SEQ ID NO: 38389 - RNA, 16 nt, Homo sapiens
uaaagcuuugugcaga

SEQ ID NO: 38390 - RNA, 16 nt, Homo sapiens
agguaccuucucaccu

SEQ ID NO: 38391 - RNA, 24 nt, Homo sapiens
ggcuuuaaaacuuauccuccauga

SEQ ID NO: 38392 - RNA, 13 nt, Homo sapiens
gaccaucccggcc

SEQ ID NO: 38393 - RNA, 17 nt, Homo sapiens
uugcuaucaauccaaga

SEQ ID NO: 38394 - RNA, 14 nt, Homo sapiens
gcuaucaauccaag

SEQ ID NO: 38395 - RNA, 13 nt, Homo sapiens
acuccacuuggac

SEQ ID NO: 38396 - RNA, 13 nt, Homo sapiens
gccccaauucgau

SEQ ID NO: 38397 - RNA, 15 nt, Homo sapiens
gaccuucccagcuag

SEQ ID NO: 38398 - RNA, 14 nt, Homo sapiens
aaaaacguauugca

SEQ ID NO: 38399 - RNA, 21 nt, Homo sapiens
gcuccucggacggcuccggac

SEQ ID NO: 38400 - RNA, 14 nt, Homo sapiens
caagccugccucaa

SEQ ID NO: 38401 - RNA, 22 nt, Homo sapiens
aaaugucauuguucuugugaac

SEQ ID NO: 38402 - RNA, 15 nt, Homo sapiens
cuuuaaaacuuaucc

SEQ ID NO: 38403 - RNA, 22 nt, Homo sapiens
ucccaggaggggcuucugggca

SEQ ID NO: 38404 - RNA, 23 nt, Homo sapiens
uucccagcuagaauucacuccac

SEQ ID NO: 38405 - RNA, 16 nt, Homo sapiens
ucauauuuauagccag

SEQ ID NO: 38406 - RNA, 13 nt, Homo sapiens
ggggaggggcgcu

SEQ ID NO: 38407 - RNA, 19 nt, Homo sapiens
cagccuuggauacuccaug

SEQ ID NO: 38408 - RNA, 11 nt, Homo sapiens
agccggagccu

SEQ ID NO: 38409 - RNA, 16 nt, Homo sapiens
uaaaguaugugcauau

SEQ ID NO: 38410 - RNA, 21 nt, Homo sapiens
cuucugacacuaaaacaccuc

SEQ ID NO: 38411 - RNA, 16 nt, Homo sapiens
cugagacacaugggug

SEQ ID NO: 38412 - RNA, 20 nt, Homo sapiens
gcccugaaagucccagauca

SEQ ID NO: 38413 - RNA, 22 nt, Homo sapiens
ucuaucauuaaaguucuaguga

SEQ ID NO: 38414 - RNA, 16 nt, Homo sapiens
cauccugugggaccug

SEQ ID NO: 38415 - RNA, 22 nt, Homo sapiens
cuccugagacacaugggugcua

SEQ ID NO: 38416 - RNA, 13 nt, Homo sapiens
uaucaguccaaag

SEQ ID NO: 38417 - RNA, 18 nt, Homo sapiens
ucuaucauuaaaguucua

SEQ ID NO: 38418 - RNA, 20 nt, Homo sapiens
cuucccagcuagaauucacu

SEQ ID NO: 38419 - RNA, 17 nt, Homo sapiens
cgccuccgcuacuucca

SEQ ID NO: 38420 - RNA, 15 nt, Homo sapiens
ccuggccgcagugag

SEQ ID NO: 38421 - RNA, 19 nt, Homo sapiens
aaauguuguuuuaggaaua

SEQ ID NO: 38422 - RNA, 20 nt, Homo sapiens
cauuguucuugugaacccaa

SEQ ID NO: 38423 - RNA, 16 nt, Homo sapiens
gcauccuagucucuau

SEQ ID NO: 38424 - RNA, 15 nt, Homo sapiens
ugaauaucaguuauu

SEQ ID NO: 38425 - RNA, 13 nt, Homo sapiens
uccgcuacuucca

SEQ ID NO: 38426 - RNA, 22 nt, Homo sapiens
uugggggggaggugagguacca

SEQ ID NO: 38427 - RNA, 19 nt, Homo sapiens
cgcucaucccacccgccca

SEQ ID NO: 38428 - RNA, 20 nt, Homo sapiens
gccucagggugcacacagga

SEQ ID NO: 38429 - RNA, 21 nt, Homo sapiens
ucaauaaaacuuuuccaauga

SEQ ID NO: 38430 - RNA, 19 nt, Homo sapiens
accauuuuugaaaccaaac

SEQ ID NO: 38431 - RNA, 12 nt, Homo sapiens
accucauuauca

SEQ ID NO: 38432 - RNA, 14 nt, Homo sapiens
ugccugcccugaaa

SEQ ID NO: 38433 - RNA, 22 nt, Homo sapiens
aauacauaaaguaugugcauau

SEQ ID NO: 38434 - RNA, 17 nt, Homo sapiens
uauagucacuaguugua

SEQ ID NO: 38435 - RNA, 20 nt, Homo sapiens
ggcggguccgggucgcagga

SEQ ID NO: 38436 - RNA, 19 nt, Homo sapiens
gcuuuaaaacuuauccucc

SEQ ID NO: 38437 - RNA, 15 nt, Homo sapiens
aagucccagaucaag

SEQ ID NO: 38438 - RNA, 20 nt, Homo sapiens
ugagccuuuguugcuaucaa

SEQ ID NO: 38439 - RNA, 23 nt, Homo sapiens
ccugaaagucccagaucaagccu

SEQ ID NO: 38440 - RNA, 20 nt, Homo sapiens
cuccauggggugggggugga

SEQ ID NO: 38441 - RNA, 17 nt, Homo sapiens
ugcagcgaguacuuccc

SEQ ID NO: 38442 - RNA, 17 nt, Homo sapiens
gcuucugggcagacucu

SEQ ID NO: 38443 - RNA, 21 nt, Homo sapiens
aauccaagaacuuauuuguac

SEQ ID NO: 38444 - RNA, 14 nt, Homo sapiens
uuccaaugacauuu

SEQ ID NO: 38445 - RNA, 17 nt, Homo sapiens
caauaaaacuuuuccaa

SEQ ID NO: 38446 - RNA, 15 nt, Homo sapiens
cuuauccuccaugaa

SEQ ID NO: 38447 - RNA, 17 nt, Homo sapiens
aaacguauugcauuuaa

SEQ ID NO: 38448 - RNA, 11 nt, Homo sapiens
acaaugcauuc

SEQ ID NO: 38449 - RNA, 22 nt, Homo sapiens
gcucgcuuccgcauccuagucu

SEQ ID NO: 38450 - RNA, 17 nt, Homo sapiens
ucaguccaaagggcaug

SEQ ID NO: 38451 - RNA, 23 nt, Homo sapiens
aacccaaagugugacucauuaaa

SEQ ID NO: 38452 - RNA, 14 nt, Homo sapiens
aaaguucuagugac

SEQ ID NO: 38453 - RNA, 18 nt, Homo sapiens
cugucacgugugggcaau

SEQ ID NO: 38454 - RNA, 20 nt, Homo sapiens
uaaaacaccucagcugccuc

SEQ ID NO: 38455 - RNA, 23 nt, Homo sapiens
uugagcuaggggggucagccagc

SEQ ID NO: 38456 - RNA, 21 nt, Homo sapiens
uccaaagggcauggguuuuau

SEQ ID NO: 38457 - RNA, 20 nt, Homo sapiens
auggcaggaggcauccaaag

SEQ ID NO: 38458 - RNA, 22 nt, Homo sapiens
ugaacugcagcgaguacuuccc

SEQ ID NO: 38459 - RNA, 22 nt, Homo sapiens
ucugccugcccugaaaguccca

SEQ ID NO: 38460 - RNA, 17 nt, Homo sapiens
ucauuguucuugugaac

SEQ ID NO: 38461 - RNA, 16 nt, Homo sapiens
accuucucaccuguga

SEQ ID NO: 38462 - RNA, 16 nt, Homo sapiens
ccgcauccuagucucu

SEQ ID NO: 38463 - RNA, 16 nt, Homo sapiens
ucuaucauuaaaguuc

SEQ ID NO: 38464 - RNA, 20 nt, Homo sapiens
acauuuuuuuuuucaauaaa

SEQ ID NO: 38465 - RNA, 14 nt, Homo sapiens
uaaaguaugugcau

SEQ ID NO: 38466 - RNA, 17 nt, Homo sapiens
cauccuagucucuauca

SEQ ID NO: 38467 - RNA, 11 nt, Homo sapiens
cgcuacuucca

SEQ ID NO: 38468 - RNA, 18 nt, Homo sapiens
gacaugggccccagauac

SEQ ID NO: 38469 - RNA, 17 nt, Homo sapiens
cggagccuccagcugcc

SEQ ID NO: 38470 - RNA, 22 nt, Homo sapiens
gagaccaaggcccccgggccga

SEQ ID NO: 38471 - RNA, 23 nt, Homo sapiens
uugcauuuaauuuauugaggcuu

SEQ ID NO: 38472 - RNA, 20 nt, Homo sapiens
aauaaaacuuuuccaaugac

SEQ ID NO: 38473 - RNA, 16 nt, Homo sapiens
caaugcauucugaggu

SEQ ID NO: 38474 - RNA, 12 nt, Homo sapiens
augggccccaga

SEQ ID NO: 38475 - RNA, 19 nt, Homo sapiens
uuggauacuccauggggug

SEQ ID NO: 38476 - RNA, 22 nt, Homo sapiens
cuuuguugcuaucaauccaaga

SEQ ID NO: 38477 - RNA, 19 nt, Homo sapiens
augucauuguucuugugaa

SEQ ID NO: 38478 - RNA, 11 nt, Homo sapiens
aacccaaagug

SEQ ID NO: 38479 - RNA, 15 nt, Homo sapiens
aaggcuccugagaca

SEQ ID NO: 38480 - RNA, 14 nt, Homo sapiens
caccugugagacca

SEQ ID NO: 38481 - RNA, 14 nt, Homo sapiens
uggcgcuggcugcg

SEQ ID NO: 38482 - RNA, 19 nt, Homo sapiens
cccucuccucucuuccucc

SEQ ID NO: 38483 - RNA, 21 nt, Homo sapiens
uuucuuccuuuuuuaguucuu

SEQ ID NO: 38484 - RNA, 21 nt, Homo sapiens
cgccuccgcuacuuccagggc

SEQ ID NO: 38485 - RNA, 16 nt, Homo sapiens
auccacacugagcuga

SEQ ID NO: 38486 - RNA, 23 nt, Homo sapiens
agcccucuucugacacuaaaaca

SEQ ID NO: 38487 - RNA, 13 nt, Homo sapiens
aaaguucuaguga

SEQ ID NO: 38488 - RNA, 17 nt, Homo sapiens
ugggccauagucauucu

SEQ ID NO: 38489 - RNA, 18 nt, Homo sapiens
gauugagaaggagcuccc

SEQ ID NO: 38490 - RNA, 20 nt, Homo sapiens
ugcgcucggccugcucgccc

SEQ ID NO: 38491 - RNA, 17 nt, Homo sapiens
cucuaucccaaccucuc

SEQ ID NO: 38492 - RNA, 21 nt, Homo sapiens
gagcuaggggggucagccagc

SEQ ID NO: 38493 - RNA, 15 nt, Homo sapiens
uuaguucuucaaaga

SEQ ID NO: 38494 - RNA, 12 nt, Homo sapiens
caugagccuuug

SEQ ID NO: 38495 - RNA, 18 nt, Homo sapiens
uaucccaaccucucccaa

SEQ ID NO: 38496 - RNA, 22 nt, Homo sapiens
agcucuaucccaaccucuccca

SEQ ID NO: 38497 - RNA, 15 nt, Homo sapiens
ucccaggaggggcuu

SEQ ID NO: 38498 - RNA, 22 nt, Homo sapiens
ucuuguaaagguccuggcaaag

SEQ ID NO: 38499 - RNA, 15 nt, Homo sapiens
ucucaccugugagac

SEQ ID NO: 38500 - RNA, 15 nt, Homo sapiens
caggcggguccgggu

SEQ ID NO: 38501 - RNA, 16 nt, Homo sapiens
ggcugcugguggcgcu

SEQ ID NO: 38502 - RNA, 17 nt, Homo sapiens
agcuagaauucacucca

SEQ ID NO: 38503 - RNA, 13 nt, Homo sapiens
cccagauaccaug

SEQ ID NO: 38504 - RNA, 18 nt, Homo sapiens
accauuuuugaaaccaaa

SEQ ID NO: 38505 - RNA, 15 nt, Homo sapiens
gcucgcccacuuccu

SEQ ID NO: 38506 - RNA, 16 nt, Homo sapiens
agucucuaucauuaaa

SEQ ID NO: 38507 - RNA, 17 nt, Homo sapiens
gcaaagaugaucaguau

SEQ ID NO: 38508 - RNA, 14 nt, Homo sapiens
aaaacguauugcau

SEQ ID NO: 38509 - RNA, 18 nt, Homo sapiens
agcucuaucccaaccucu

SEQ ID NO: 38510 - RNA, 16 nt, Homo sapiens
agggaagggggaacau

SEQ ID NO: 38511 - RNA, 13 nt, Homo sapiens
agccuccagcugc

SEQ ID NO: 38512 - RNA, 20 nt, Homo sapiens
acacuaaaacaccucagcug

SEQ ID NO: 38513 - RNA, 13 nt, Homo sapiens
ugagguaccagcc

SEQ ID NO: 38514 - RNA, 16 nt, Homo sapiens
cauuuuugaaaccaaa

SEQ ID NO: 38515 - RNA, 16 nt, Homo sapiens
auucgauccccuguca

SEQ ID NO: 38516 - RNA, 15 nt, Homo sapiens
aaagucccagaucaa

SEQ ID NO: 38517 - RNA, 15 nt, Homo sapiens
agccuccagcugccc

SEQ ID NO: 38518 - RNA, 15 nt, Homo sapiens
agugugacucauuaa

SEQ ID NO: 38519 - RNA, 20 nt, Homo sapiens
aaaaaacguauugcauuuaa

SEQ ID NO: 38520 - RNA, 14 nt, Homo sapiens
ucuuccucccugga

SEQ ID NO: 38521 - RNA, 10 nt, Homo sapiens
acccccagaa

SEQ ID NO: 38522 - RNA, 17 nt, Homo sapiens
auccuagucucuaucau

SEQ ID NO: 38523 - RNA, 22 nt, Homo sapiens
agucucuaucauuaaaguucua

SEQ ID NO: 38524 - RNA, 19 nt, Homo sapiens
cagcgaguacuucccgcug

SEQ ID NO: 38525 - RNA, 20 nt, Homo sapiens
uuacccccugggagccccaa

SEQ ID NO: 38526 - RNA, 18 nt, Homo sapiens
agcuagaauucacuccac

SEQ ID NO: 38527 - RNA, 15 nt, Homo sapiens
uccgcauccuagucu

SEQ ID NO: 38528 - RNA, 20 nt, Homo sapiens
aauacauaaaguaugugcau

SEQ ID NO: 38529 - RNA, 16 nt, Homo sapiens
cuagaauucacuccac

SEQ ID NO: 38530 - RNA, 17 nt, Homo sapiens
ucauuaucaguccaaag

SEQ ID NO: 38531 - RNA, 14 nt, Homo sapiens
gcagacucugguca

SEQ ID NO: 38532 - RNA, 20 nt, Homo sapiens
accuucccagcuagaauuca

SEQ ID NO: 38533 - RNA, 20 nt, Homo sapiens
gagcggaccuucccagcuag

SEQ ID NO: 38534 - RNA, 14 nt, Homo sapiens
auccugugggaccu

SEQ ID NO: 38535 - RNA, 20 nt, Homo sapiens
cggggaggggcgcucgcuuc

SEQ ID NO: 38536 - RNA, 21 nt, Homo sapiens
gaacaugagccuuuguugcua

SEQ ID NO: 38537 - RNA, 23 nt, Homo sapiens
uccuggcaaagaugaucaguaug

SEQ ID NO: 38538 - RNA, 17 nt, Homo sapiens
gccuuggauacuccaug

SEQ ID NO: 38539 - RNA, 17 nt, Homo sapiens
augagccuuuguugcua

SEQ ID NO: 38540 - RNA, 15 nt, Homo sapiens
cggccugcucgccca

SEQ ID NO: 38541 - RNA, 22 nt, Homo sapiens
ucagccagcccucuucugacac

SEQ ID NO: 38542 - RNA, 15 nt, Homo sapiens
cagcgaguacuuccc

SEQ ID NO: 38543 - RNA, 14 nt, Homo sapiens
agcugccccgggga

SEQ ID NO: 38544 - RNA, 18 nt, Homo sapiens
ugugaacccaaaguguga

SEQ ID NO: 38545 - RNA, 19 nt, Homo sapiens
gcuccugagacacaugggu

SEQ ID NO: 38546 - RNA, 17 nt, Homo sapiens
ucaauccaagaacuuau

SEQ ID NO: 38547 - RNA, 17 nt, Homo sapiens
caaaggcuccugagaca

SEQ ID NO: 38548 - RNA, 16 nt, Homo sapiens
aguaugaaaaugucau

SEQ ID NO: 38549 - RNA, 17 nt, Homo sapiens
uccagcugccccgggga

SEQ ID NO: 38550 - RNA, 22 nt, Homo sapiens
agccuuggauacuccauggggu

SEQ ID NO: 38551 - RNA, 17 nt, Homo sapiens
agagccggagccuccag

SEQ ID NO: 38552 - RNA, 17 nt, Homo sapiens
gcuccugagacacaugg

SEQ ID NO: 38553 - RNA, 20 nt, Homo sapiens
ccccagauaccaugaugcug

SEQ ID NO: 38554 - RNA, 16 nt, Homo sapiens
gggugaacugcagcga

SEQ ID NO: 38555 - RNA, 13 nt, Homo sapiens
accuucccagcua

SEQ ID NO: 38556 - RNA, 16 nt, Homo sapiens
cugggccauagucauu

SEQ ID NO: 38557 - RNA, 17 nt, Homo sapiens
cgugggccugagaccaa

SEQ ID NO: 38558 - RNA, 19 nt, Homo sapiens
cuuugugcagauucuuuac

SEQ ID NO: 38559 - RNA, 13 nt, Homo sapiens
uagucucuaucau

SEQ ID NO: 38560 - RNA, 21 nt, Homo sapiens
cugugagaccaaauugagcua

SEQ ID NO: 38561 - RNA, 18 nt, Homo sapiens
agccagguaccuucucac

SEQ ID NO: 38562 - RNA, 12 nt, Homo sapiens
gcauccuagucu

SEQ ID NO: 38563 - RNA, 14 nt, Homo sapiens
ugcuaucaauccaa

SEQ ID NO: 38564 - RNA, 19 nt, Homo sapiens
agccgggaaagaagagccg

SEQ ID NO: 38565 - RNA, 13 nt, Homo sapiens
ccgugugccugag

SEQ ID NO: 38566 - RNA, 16 nt, Homo sapiens
ggcuccugagacacau

SEQ ID NO: 38567 - RNA, 19 nt, Homo sapiens
ccagccuuggauacuccau

SEQ ID NO: 38568 - RNA, 20 nt, Homo sapiens
acaggauggcaggaggcauc

SEQ ID NO: 38569 - RNA, 13 nt, Homo sapiens
uccgcauccuagu

SEQ ID NO: 38570 - RNA, 15 nt, Homo sapiens
uaugaaaaugucauu

SEQ ID NO: 38571 - RNA, 14 nt, Homo sapiens
aaagguccuggcaa

SEQ ID NO: 38572 - RNA, 22 nt, Homo sapiens
cacuaaaacaccucagcugccu

SEQ ID NO: 38573 - RNA, 12 nt, Homo sapiens
ccgcuacuucca

SEQ ID NO: 38574 - RNA, 18 nt, Homo sapiens
uagucucuaucauuaaag

SEQ ID NO: 38575 - RNA, 22 nt, Homo sapiens
aaggcuccugagacacaugggu

SEQ ID NO: 38576 - RNA, 20 nt, Homo sapiens
auucauauuuauagccaggu

SEQ ID NO: 38577 - RNA, 17 nt, Homo sapiens
cauaaaguaugugcaua

SEQ ID NO: 38578 - RNA, 14 nt, Homo sapiens
augaucaguaugaa

SEQ ID NO: 38579 - RNA, 17 nt, Homo sapiens
ucagcugccuccccagc

SEQ ID NO: 38580 - RNA, 15 nt, Homo sapiens
cuccgcuacuuccag

SEQ ID NO: 38581 - RNA, 20 nt, Homo sapiens
aaacuuuuccaaugacauuu

SEQ ID NO: 38582 - RNA, 10 nt, Homo sapiens
cauccaaagg

SEQ ID NO: 38583 - RNA, 12 nt, Homo sapiens
cgugugccugag

SEQ ID NO: 38584 - RNA, 18 nt, Homo sapiens
auucuuuacccccuggga

SEQ ID NO: 38585 - RNA, 18 nt, Homo sapiens
ugagacacaugggugcua

SEQ ID NO: 38586 - RNA, 13 nt, Homo sapiens
agaucaagccugc

SEQ ID NO: 38587 - RNA, 14 nt, Homo sapiens
uaaaacuaggugcu

SEQ ID NO: 38588 - RNA, 22 nt, Homo sapiens
agccuuuguugcuaucaaucca

SEQ ID NO: 38589 - RNA, 24 nt, Homo sapiens
aauacauaaaguaugugcauauuu

SEQ ID NO: 38590 - RNA, 14 nt, Homo sapiens
ugagcggaccuucc

SEQ ID NO: 38591 - RNA, 20 nt, Homo sapiens
gcgcgccuccgcuacuucca

SEQ ID NO: 38592 - RNA, 17 nt, Homo sapiens
ugcauuuaauuuauuga

SEQ ID NO: 38593 - RNA, 20 nt, Homo sapiens
cucgcuuccgcauccuaguc

SEQ ID NO: 38594 - RNA, 19 nt, Homo sapiens
cuaggggggucagccagcc

SEQ ID NO: 38595 - RNA, 21 nt, Homo sapiens
cagcccucuucugacacuaaa

SEQ ID NO: 38596 - RNA, 16 nt, Homo sapiens
ccuucuuacaaugcau

SEQ ID NO: 38597 - RNA, 16 nt, Homo sapiens
cgugugggcaauguuc

SEQ ID NO: 38598 - RNA, 16 nt, Homo sapiens
cuucuuacaaugcauu

SEQ ID NO: 38599 - RNA, 20 nt, Homo sapiens
aaacuccacauccuguggga

SEQ ID NO: 38600 - RNA, 18 nt, Homo sapiens
gacucuggucaagaagca

SEQ ID NO: 38601 - RNA, 14 nt, Homo sapiens
ucccaacuauaaaa

SEQ ID NO: 38602 - RNA, 19 nt, Homo sapiens
acuccacuuggacaugggc

SEQ ID NO: 38603 - RNA, 15 nt, Homo sapiens
agacacaugggugcu

SEQ ID NO: 38604 - RNA, 14 nt, Homo sapiens
gagccuuuguugcu

SEQ ID NO: 38605 - RNA, 19 nt, Homo sapiens
ccuccaugaauaucaguua

SEQ ID NO: 38606 - RNA, 19 nt, Homo sapiens
uccacauccugugggaccu

SEQ ID NO: 38607 - RNA, 13 nt, Homo sapiens
uggaaucuuguaa

SEQ ID NO: 38608 - RNA, 23 nt, Homo sapiens
uaccaugaugcugagcccggaaa

SEQ ID NO: 38609 - RNA, 17 nt, Homo sapiens
cuaggggggucagccag

SEQ ID NO: 38610 - RNA, 21 nt, Homo sapiens
ggcaauguucccccucuccuc

SEQ ID NO: 38611 - RNA, 17 nt, Homo sapiens
agccagguaccuucuca

SEQ ID NO: 38612 - RNA, 14 nt, Homo sapiens
agccccaauucgau

SEQ ID NO: 38613 - RNA, 19 nt, Homo sapiens
gaaacuccacauccugugg

SEQ ID NO: 38614 - RNA, 21 nt, Homo sapiens
aggauggcaggaggcauccaa

SEQ ID NO: 38615 - RNA, 22 nt, Homo sapiens
gagggcgcggggcggggagcga

SEQ ID NO: 38616 - RNA, 23 nt, Homo sapiens
uggcguuguggggaugaacuuuu

SEQ ID NO: 38617 - RNA, 13 nt, Homo sapiens
cccgugugccuga

SEQ ID NO: 38618 - RNA, 15 nt, Homo sapiens
cucgcccacuuccuc

SEQ ID NO: 38619 - RNA, 23 nt, Homo sapiens
cuccugagacacaugggugcuau

SEQ ID NO: 38620 - RNA, 22 nt, Homo sapiens
uaccagccuuggauacuccaug

SEQ ID NO: 38621 - RNA, 22 nt, Homo sapiens
gcugccgugggccugagaccaa

SEQ ID NO: 38622 - RNA, 17 nt, Homo sapiens
gccucaaucaguauuca

SEQ ID NO: 38623 - RNA, 16 nt, Homo sapiens
uucucaccugugagac

SEQ ID NO: 38624 - RNA, 19 nt, Homo sapiens
aggaauacauaaaguaugu

SEQ ID NO: 38625 - RNA, 14 nt, Homo sapiens
aaagcuuugugcag

SEQ ID NO: 38626 - RNA, 18 nt, Homo sapiens
uauccuccaugaauauca

SEQ ID NO: 38627 - RNA, 23 nt, Homo sapiens
uacuucccgcuguuccucgccac

SEQ ID NO: 38628 - RNA, 17 nt, Homo sapiens
ugaaagucccagaucaa

SEQ ID NO: 38629 - RNA, 19 nt, Homo sapiens
gagcuaggggggucagcca

SEQ ID NO: 38630 - RNA, 17 nt, Homo sapiens
gguccgggucgcaggac

SEQ ID NO: 38631 - RNA, 21 nt, Homo sapiens
acuguaaagcuuugugcagau

SEQ ID NO: 38632 - RNA, 20 nt, Homo sapiens
ccaggcacccccagaaugac

SEQ ID NO: 38633 - RNA, 19 nt, Homo sapiens
ccugagcggaccuucccag

SEQ ID NO: 38634 - RNA, 23 nt, Homo sapiens
uaauuuuuuugugggaaauccac

SEQ ID NO: 38635 - RNA, 19 nt, Homo sapiens
uggacaugggccccagaua

SEQ ID NO: 38636 - RNA, 14 nt, Homo sapiens
cacugagcugaggg

SEQ ID NO: 38637 - RNA, 12 nt, Homo sapiens
uaaaacaccuca

SEQ ID NO: 38638 - RNA, 16 nt, Homo sapiens
agccuuggauacucca

SEQ ID NO: 38639 - RNA, 12 nt, Homo sapiens
ucucuaucauua

SEQ ID NO: 38640 - RNA, 19 nt, Homo sapiens
ccucagggugcacacagga

SEQ ID NO: 38641 - RNA, 21 nt, Homo sapiens
ggccccagauaccaugaugcu

SEQ ID NO: 38642 - RNA, 15 nt, Homo sapiens
uccugagacacaugg

SEQ ID NO: 38643 - RNA, 18 nt, Homo sapiens
agucacuaguuguaauuu

SEQ ID NO: 38644 - RNA, 16 nt, Homo sapiens
ugcauauuuuauuaua

SEQ ID NO: 38645 - RNA, 20 nt, Homo sapiens
caugaugcugagcccggaaa

SEQ ID NO: 38646 - RNA, 15 nt, Homo sapiens
cuugugaacccaaag

SEQ ID NO: 38647 - RNA, 21 nt, Homo sapiens
cuggcugcgcucggccugcuc

SEQ ID NO: 38648 - RNA, 17 nt, Homo sapiens
uguugcuaucaauccaa

SEQ ID NO: 38649 - RNA, 15 nt, Homo sapiens
cagcugccccgggga

SEQ ID NO: 38650 - RNA, 23 nt, Homo sapiens
auucugagguaaccucauuauca

SEQ ID NO: 38651 - RNA, 14 nt, Homo sapiens
auuuuugaaaccaa

SEQ ID NO: 38652 - RNA, 17 nt, Homo sapiens
caggaccaucccggccg

SEQ ID NO: 38653 - RNA, 18 nt, Homo sapiens
gcuuccgcauccuagucu

SEQ ID NO: 38654 - RNA, 15 nt, Homo sapiens
gcccggaaacuccac

SEQ ID NO: 38655 - RNA, 13 nt, Homo sapiens
aucaguccaaagg

SEQ ID NO: 38656 - RNA, 22 nt, Homo sapiens
auuuuuuugugggaaauccaca

SEQ ID NO: 38657 - RNA, 16 nt, Homo sapiens
ucuuccucccuggaau

SEQ ID NO: 38658 - RNA, 21 nt, Homo sapiens
gcucgcuuccgcauccuaguc

SEQ ID NO: 38659 - RNA, 15 nt, Homo sapiens
gauaccaugaugcug

SEQ ID NO: 38660 - RNA, 23 nt, Homo sapiens
agcgcgcgcgcccucuggcugcu

SEQ ID NO: 38661 - RNA, 20 nt, Homo sapiens
uguuguuuuaggaauacaua

SEQ ID NO: 38662 - RNA, 15 nt, Homo sapiens
agcccggaaacucca

SEQ ID NO: 38663 - RNA, 23 nt, Homo sapiens
gugaacugcagcgaguacuuccc

SEQ ID NO: 38664 - RNA, 16 nt, Homo sapiens
caagccugccucaauc

SEQ ID NO: 38665 - RNA, 18 nt, Homo sapiens
cugagcccggaaacucca

SEQ ID NO: 38666 - RNA, 19 nt, Homo sapiens
uccaaaggcuccugagaca

SEQ ID NO: 38667 - RNA, 18 nt, Homo sapiens
cugcagccccugggacca

SEQ ID NO: 38668 - RNA, 16 nt, Homo sapiens
cagaucaagccugccu

SEQ ID NO: 38669 - RNA, 22 nt, Homo sapiens
ucauuguucuugugaacccaaa

SEQ ID NO: 38670 - RNA, 19 nt, Homo sapiens
cauauuuuauuauagucac

SEQ ID NO: 38671 - RNA, 15 nt, Homo sapiens
gcgcgcucaucccac

SEQ ID NO: 38672 - RNA, 15 nt, Homo sapiens
aaaaacguauugcau

SEQ ID NO: 38673 - RNA, 19 nt, Homo sapiens
cugcagccccugggaccag

SEQ ID NO: 38674 - RNA, 14 nt, Homo sapiens
ggagccuccagcug

SEQ ID NO: 38675 - RNA, 15 nt, Homo sapiens
gaaagucccagauca

SEQ ID NO: 38676 - RNA, 13 nt, Homo sapiens
ugcuaucaaucca

SEQ ID NO: 38677 - RNA, 15 nt, Homo sapiens
aaccucauuaucagu

SEQ ID NO: 38678 - RNA, 23 nt, Homo sapiens
agcuaggggggucagccagcccu

SEQ ID NO: 38679 - RNA, 15 nt, Homo sapiens
ccugagacacauggg

SEQ ID NO: 38680 - RNA, 18 nt, Homo sapiens
aguaugaaaaugucauug

SEQ ID NO: 38681 - RNA, 18 nt, Homo sapiens
cagugaggcggauugaga

SEQ ID NO: 38682 - RNA, 18 nt, Homo sapiens
ggugagguaccagccuug

SEQ ID NO: 38683 - RNA, 22 nt, Homo sapiens
ugaggcuuuaaaacuuauccuc

SEQ ID NO: 38684 - RNA, 14 nt, Homo sapiens
gugugacucauuaa

SEQ ID NO: 38685 - RNA, 16 nt, Homo sapiens
caaucaguauucauau

SEQ ID NO: 38686 - RNA, 17 nt, Homo sapiens
cccaaagugugacucau

SEQ ID NO: 38687 - RNA, 18 nt, Homo sapiens
ugaucaguaugaaaaugu

SEQ ID NO: 38688 - RNA, 18 nt, Homo sapiens
gagacacaugggugcuau

SEQ ID NO: 38689 - RNA, 14 nt, Homo sapiens
cucaucccacccgc

SEQ ID NO: 38690 - RNA, 21 nt, Homo sapiens
cccagcuagaauucacuccac

SEQ ID NO: 38691 - RNA, 17 nt, Homo sapiens
uuugaaaccaaaccaga

SEQ ID NO: 38692 - RNA, 16 nt, Homo sapiens
gcuagaauucacucca

SEQ ID NO: 38693 - RNA, 16 nt, Homo sapiens
uuccgcauccuagucu

SEQ ID NO: 38694 - RNA, 21 nt, Homo sapiens
auucugagguaaccucauuau

SEQ ID NO: 38695 - RNA, 15 nt, Homo sapiens
agccccugggaccag

SEQ ID NO: 38696 - RNA, 17 nt, Homo sapiens
aucaguccaaagggcau

SEQ ID NO: 38697 - RNA, 19 nt, Homo sapiens
acaugagccuuuguugcua

SEQ ID NO: 38698 - RNA, 14 nt, Homo sapiens
gccagguaccuucu

SEQ ID NO: 38699 - RNA, 16 nt, Homo sapiens
uaucaauccaagaacu

SEQ ID NO: 38700 - RNA, 20 nt, Homo sapiens
uacauaaaguaugugcauau

SEQ ID NO: 38701 - RNA, 17 nt, Homo sapiens
ccugaaagucccagauc

SEQ ID NO: 38702 - RNA, 23 nt, Homo sapiens
ugcauucugagguaaccucauua

SEQ ID NO: 38703 - RNA, 19 nt, Homo sapiens
ucuuacaaugcauucugag

SEQ ID NO: 38704 - RNA, 20 nt, Homo sapiens
uuacaaugcauucugaggua

SEQ ID NO: 38705 - RNA, 14 nt, Homo sapiens
ucugccugcccuga

SEQ ID NO: 38706 - RNA, 22 nt, Homo sapiens
cagcugccuccccagcucuauc

SEQ ID NO: 38707 - RNA, 18 nt, Homo sapiens
uagccagguaccuucuca

SEQ ID NO: 38708 - RNA, 14 nt, Homo sapiens
ucaagccugccuca

SEQ ID NO: 38709 - RNA, 21 nt, Homo sapiens
ugacacuaaaacaccucagcu

SEQ ID NO: 38710 - RNA, 19 nt, Homo sapiens
ugagcggaccuucccagcu

SEQ ID NO: 38711 - RNA, 13 nt, Homo sapiens
ugccuccccagcu

SEQ ID NO: 38712 - RNA, 14 nt, Homo sapiens
gaccuucccagcua

SEQ ID NO: 38713 - RNA, 20 nt, Homo sapiens
gccucagggugcacacagga

SEQ ID NO: 38714 - RNA, 13 nt, Homo sapiens
gcggaccuuccca

SEQ ID NO: 38715 - RNA, 19 nt, Homo sapiens
gcguuguggggaugaacuu

SEQ ID NO: 38716 - RNA, 14 nt, Homo sapiens
gcggaccuucccag

SEQ ID NO: 38717 - RNA, 13 nt, Homo sapiens
gcuaucaauccaa

SEQ ID NO: 38718 - RNA, 18 nt, Homo sapiens
gccagcccucuucugaca

SEQ ID NO: 38719 - RNA, 18 nt, Homo sapiens
gccauagucauucugccu

SEQ ID NO: 38720 - RNA, 13 nt, Homo sapiens
gccuccccagcuc

SEQ ID NO: 38721 - RNA, 12 nt, Homo sapiens
cgugugccugag

SEQ ID NO: 38722 - RNA, 14 nt, Homo sapiens
cucuucugacacua

SEQ ID NO: 38723 - RNA, 13 nt, Homo sapiens
cugccucaaucag

SEQ ID NO: 38724 - RNA, 24 nt, Homo sapiens
gcugccuccccagcucuaucccaa

SEQ ID NO: 38725 - RNA, 22 nt, Homo sapiens
gcugcagccccugggaccaggc

SEQ ID NO: 38726 - RNA, 23 nt, Homo sapiens
guacauuuuuuuuuucaauaaaa

SEQ ID NO: 38727 - RNA, 22 nt, Homo sapiens
guacauuuuuuuuuucaauaaa

SEQ ID NO: 38728 - RNA, 17 nt, Homo sapiens
ucccagcuagaauucac

SEQ ID NO: 38729 - RNA, 23 nt, Homo sapiens
ucaccugugagaccaaauugagc

SEQ ID NO: 38730 - RNA, 20 nt, Homo sapiens
uacauuuuuuuuuucaauaa

SEQ ID NO: 38731 - RNA, 21 nt, Homo sapiens
uacauuuuuuuuuucaauaaa

SEQ ID NO: 38732 - RNA, 19 nt, Homo sapiens
cagcuagaauucacuccac

SEQ ID NO: 38733 - RNA, 12 nt, Homo sapiens
caugaugcugag

SEQ ID NO: 38734 - RNA, 13 nt, Homo sapiens
cucuucugacacu

SEQ ID NO: 38735 - RNA, 12 nt, Homo sapiens
cugccucaauca

SEQ ID NO: 38736 - RNA, 14 nt, Homo sapiens
gaaagucccagauc

SEQ ID NO: 38737 - RNA, 19 nt, Homo sapiens
cuaucccaaccucucccaa

SEQ ID NO: 38738 - RNA, 16 nt, Homo sapiens
uguugcuaucaaucca

SEQ ID NO: 38739 - RNA, 17 nt, Homo sapiens
uguugcuaucaauccaa

SEQ ID NO: 38740 - RNA, 15 nt, Homo sapiens
agcccucuucugaca

SEQ ID NO: 38741 - RNA, 23 nt, Homo sapiens
agccuuuguugcuaucaauccaa

SEQ ID NO: 38742 - RNA, 22 nt, Homo sapiens
aggcauccaaaggcuccugaga

SEQ ID NO: 38743 - RNA, 22 nt, Homo sapiens
caagaacuuauuuguacauuuu

SEQ ID NO: 38744 - RNA, 10 nt, Homo sapiens
caaagauagg

SEQ ID NO: 38745 - RNA, 14 nt, Homo sapiens
caaaggcuccugag

SEQ ID NO: 38746 - RNA, 20 nt, Homo sapiens
ccugagcggaccuucccagc

SEQ ID NO: 38747 - RNA, 16 nt, Homo sapiens
cccugaaagucccaga

SEQ ID NO: 38748 - RNA, 14 nt, Homo sapiens
caggaggcauccaa

SEQ ID NO: 38749 - RNA, 14 nt, Homo sapiens
cagguaccuucuca

SEQ ID NO: 38750 - RNA, 18 nt, Homo sapiens
cagcuagaauucacucca

SEQ ID NO: 38751 - RNA, 23 nt, Homo sapiens
cagcucuaucccaaccucuccca

SEQ ID NO: 38752 - RNA, 19 nt, Homo sapiens
cagacucuggucaagaagc

SEQ ID NO: 38753 - RNA, 17 nt, Homo sapiens
aguucuucaaagauagg

SEQ ID NO: 38754 - RNA, 18 nt, Homo sapiens
aacuuuuuguuuuguuuc

SEQ ID NO: 38755 - RNA, 16 nt, Homo sapiens
aaugacauuuuguugg

SEQ ID NO: 38756 - RNA, 16 nt, Homo sapiens
accaaauugagcuagg

SEQ ID NO: 38757 - RNA, 17 nt, Homo sapiens
acuuuuccaaugacauu

SEQ ID NO: 38758 - RNA, 18 nt, Homo sapiens
acuuuuccaaugacauuu

SEQ ID NO: 38759 - RNA, 14 nt, Homo sapiens
acuauaaaacuagg

SEQ ID NO: 38760 - RNA, 21 nt, Homo sapiens
aaacuuuuccaaugacauuuu

SEQ ID NO: 38761 - RNA, 18 nt, Homo sapiens
aacaugagccuuuguugc

SEQ ID NO: 38762 - RNA, 17 nt, Homo sapiens
aauucacuccacuugga

SEQ ID NO: 38763 - RNA, 18 nt, Homo sapiens
cuccacuuggacaugggc

SEQ ID NO: 38764 - RNA, 18 nt, Homo sapiens
auggcaggaggcauccaa

SEQ ID NO: 38765 - RNA, 18 nt, Homo sapiens
aggcacccccagaaugac

SEQ ID NO: 38766 - RNA, 17 nt, Homo sapiens
uucacuccacuuggaca

SEQ ID NO: 38767 - RNA, 16 nt, Homo sapiens
uagccagguaccuucu

SEQ ID NO: 38768 - RNA, 17 nt, Homo sapiens
uugagcuagggggguca

SEQ ID NO: 38769 - RNA, 18 nt, Homo sapiens
accuucucaccugugaga

SEQ ID NO: 38770 - RNA, 17 nt, Homo sapiens
gcuucugggcagacucu

SEQ ID NO: 38771 - RNA, 21 nt, Homo sapiens
cuucugacacuaaaacaccuc

SEQ ID NO: 38772 - RNA, 19 nt, Homo sapiens
uaaaacuaggugcugcagc

SEQ ID NO: 38773 - RNA, 22 nt, Homo sapiens
cuccugagacacaugggugcua

SEQ ID NO: 38774 - RNA, 20 nt, Homo sapiens
agcucuaucccaaccucucc

SEQ ID NO: 38775 - RNA, 18 nt, Homo sapiens
gacucuggucaagaagca

SEQ ID NO: 38776 - RNA, 18 nt, Homo sapiens
cuauaaaacuaggugcug

SEQ ID NO: 38777 - RNA, 22 nt, Homo sapiens
aaagucccagaucaagccugcc

SEQ ID NO: 38778 - RNA, 22 nt, Homo sapiens
agccuuuguugcuaucaaucca

SEQ ID NO: 38779 - RNA, 17 nt, Homo sapiens
ccugaaagucccagauc

SEQ ID NO: 38780 - RNA, 12 nt, Homo sapiens
uaaaacaccuca

SEQ ID NO: 38781 - RNA, 15 nt, Homo sapiens
gaaagucccagauca

SEQ ID NO: 38782 - RNA, 21 nt, Homo sapiens
ccugagcggaccuucccagcu

SEQ ID NO: 38783 - RNA, 14 nt, Homo sapiens
ucugccugcccuga

SEQ ID NO: 38784 - RNA, 19 nt, Homo sapiens
cuaggggggucagccagcc

SEQ ID NO: 38785 - RNA, 20 nt, Homo sapiens
acaggauggcaggaggcauc

SEQ ID NO: 38786 - RNA, 17 nt, Homo sapiens
gacacuaaaacaccuca

SEQ ID NO: 38787 - RNA, 15 nt, Homo sapiens
cagacucuggucaag

SEQ ID NO: 38788 - RNA, 20 nt, Homo sapiens
ccaggcacccccagaaugac

SEQ ID NO: 38789 - RNA, 16 nt, Homo sapiens
accuucucaccuguga

SEQ ID NO: 38790 - RNA, 16 nt, Homo sapiens
cugggccauagucauu

SEQ ID NO: 38791 - RNA, 15 nt, Homo sapiens
cccagcuagaauuca

SEQ ID NO: 38792 - RNA, 20 nt, Homo sapiens
guaccuucucaccugugaga

SEQ ID NO: 38793 - RNA, 13 nt, Homo sapiens
acuccacuuggac

SEQ ID NO: 38794 - RNA, 18 nt, Homo sapiens
agcuagaauucacuccac

SEQ ID NO: 38795 - RNA, 16 nt, Homo sapiens
ucauauuuauagccag

SEQ ID NO: 38796 - RNA, 16 nt, Homo sapiens
uucucaccugugagac

SEQ ID NO: 38797 - RNA, 13 nt, Homo sapiens
ugagguaccagcc

SEQ ID NO: 38798 - RNA, 14 nt, Homo sapiens
gcuaucaauccaag

SEQ ID NO: 38799 - RNA, 15 nt, Homo sapiens
ccuggccgcagugag

SEQ ID NO: 38800 - RNA, 16 nt, Homo sapiens
caaucaguauucauau

SEQ ID NO: 38801 - RNA, 16 nt, Homo sapiens
cugagacacaugggug

SEQ ID NO: 38802 - RNA, 17 nt, Homo sapiens
ugcagccccugggacca

SEQ ID NO: 38803 - RNA, 17 nt, Homo sapiens
uugcuaucaauccaaga

SEQ ID NO: 38804 - RNA, 19 nt, Homo sapiens
agguaccagccuuggauac

SEQ ID NO: 38805 - RNA, 23 nt, Homo sapiens
uugagcuaggggggucagccagc

SEQ ID NO: 38806 - RNA, 18 nt, Homo sapiens
uaucccaaccucucccaa

SEQ ID NO: 38807 - RNA, 17 nt, Homo sapiens
ccaggcacccccagaau

SEQ ID NO: 38808 - RNA, 20 nt, Homo sapiens
gugagaccaaauugagcuag

SEQ ID NO: 38809 - RNA, 22 nt, Homo sapiens
agcucuaucccaaccucuccca

SEQ ID NO: 38810 - RNA, 15 nt, Homo sapiens
cugagacacaugggu

SEQ ID NO: 38811 - RNA, 15 nt, Homo sapiens
cuagaauucacucca

SEQ ID NO: 38812 - RNA, 14 nt, Homo sapiens
accugugagaccaa

SEQ ID NO: 38813 - RNA, 23 nt, Homo sapiens
aagccugccucaaucaguauuca

SEQ ID NO: 38814 - RNA, 11 nt, Homo sapiens
uaccuucucac

SEQ ID NO: 38815 - RNA, 18 nt, Homo sapiens
ugagacacaugggugcua

SEQ ID NO: 38816 - RNA, 16 nt, Homo sapiens
ggaacaugagccuuug

SEQ ID NO: 38817 - RNA, 17 nt, Homo sapiens
cagccuuggauacucca

SEQ ID NO: 38818 - RNA, 21 nt, Homo sapiens
aauccaagaacuuauuuguac

SEQ ID NO: 38819 - RNA, 16 nt, Homo sapiens
caagccugccucaauc

SEQ ID NO: 38820 - RNA, 13 nt, Homo sapiens
agaucaagccugc

SEQ ID NO: 38821 - RNA, 16 nt, Homo sapiens
aagaacuuauuuguac

SEQ ID NO: 38822 - RNA, 18 nt, Homo sapiens
ccacauccugugggaccu

SEQ ID NO: 38823 - RNA, 17 nt, Homo sapiens
gccugagcggaccuucc

SEQ ID NO: 38824 - RNA, 23 nt, Homo sapiens
uggcguuguggggaugaacuuuu

SEQ ID NO: 38825 - RNA, 20 nt, Homo sapiens
acuccacuuggacaugggcc

SEQ ID NO: 38826 - RNA, 16 nt, Homo sapiens
agguaccuucucaccu

SEQ ID NO: 38827 - RNA, 15 nt, Homo sapiens
aaggcuccugagaca

SEQ ID NO: 38828 - RNA, 12 nt, Homo sapiens
caugagccuuug

SEQ ID NO: 38829 - RNA, 15 nt, Homo sapiens
cugccugcccugaaa

SEQ ID NO: 38830 - RNA, 15 nt, Homo sapiens
ucucaccugugagac

SEQ ID NO: 38831 - RNA, 19 nt, Homo sapiens
ccugagcggaccuucccag

SEQ ID NO: 38832 - RNA, 13 nt, Homo sapiens
ugagacacauggg

SEQ ID NO: 38833 - RNA, 13 nt, Homo sapiens
gagacacaugggu

SEQ ID NO: 38834 - RNA, 19 nt, Homo sapiens
uccaaaggcuccugagaca

SEQ ID NO: 38835 - RNA, 23 nt, Homo sapiens
agcuaggggggucagccagcccu

SEQ ID NO: 38836 - RNA, 17 nt, Homo sapiens
cuaggggggucagccag

SEQ ID NO: 38837 - RNA, 16 nt, Homo sapiens
aaacaccucagcugcc

SEQ ID NO: 38838 - RNA, 19 nt, Homo sapiens
ccucagggugcacacagga

SEQ ID NO: 38839 - RNA, 14 nt, Homo sapiens
gagccuuuguugcu

SEQ ID NO: 38840 - RNA, 13 nt, Homo sapiens
cccagauaccaug

SEQ ID NO: 38841 - RNA, 14 nt, Homo sapiens
caagccugccucaa

SEQ ID NO: 38842 - RNA, 15 nt, Homo sapiens
gaccuucccagcuag

SEQ ID NO: 38843 - RNA, 21 nt, Homo sapiens
ugaaagucccagaucaagccu

SEQ ID NO: 38844 - RNA, 21 nt, Homo sapiens
ucaauaaaacuuuuccaauga

SEQ ID NO: 38845 - RNA, 15 nt, Homo sapiens
agccccugggaccag

SEQ ID NO: 38846 - RNA, 20 nt, Homo sapiens
gccucagggugcacacagga

SEQ ID NO: 38847 - RNA, 16 nt, Homo sapiens
acaccucagcugccuc

SEQ ID NO: 38848 - RNA, 22 nt, Homo sapiens
cacuaaaacaccucagcugccu

SEQ ID NO: 38849 - RNA, 13 nt, Homo sapiens
cccgugugccuga

SEQ ID NO: 38850 - RNA, 22 nt, Homo sapiens
caggauggcaggaggcauccaa

SEQ ID NO: 38851 - RNA, 15 nt, Homo sapiens
ucuaucccaaccucu

SEQ ID NO: 38852 - RNA, 19 nt, Homo sapiens
uggacaugggccccagaua

SEQ ID NO: 38853 - RNA, 19 nt, Homo sapiens
gagcuaggggggucagcca

SEQ ID NO: 38854 - RNA, 23 nt, Homo sapiens
ccugaaagucccagaucaagccu

SEQ ID NO: 38855 - RNA, 18 nt, Homo sapiens
cugacacuaaaacaccuc

SEQ ID NO: 38856 - RNA, 21 nt, Homo sapiens
gagcuaggggggucagccagc

SEQ ID NO: 38857 - RNA, 15 nt, Homo sapiens
agacacaugggugcu

SEQ ID NO: 38858 - RNA, 14 nt, Homo sapiens
ucccaacuauaaaa

SEQ ID NO: 38859 - RNA, 13 nt, Homo sapiens
uccugugggaccu

SEQ ID NO: 38860 - RNA, 20 nt, Homo sapiens
aauaaaacuuuuccaaugac

SEQ ID NO: 38861 - RNA, 20 nt, Homo sapiens
auggcaggaggcauccaaag

SEQ ID NO: 38862 - RNA, 20 nt, Homo sapiens
caugaugcugagcccggaaa

SEQ ID NO: 38863 - RNA, 16 nt, Homo sapiens
gcuagaauucacucca

SEQ ID NO: 38864 - RNA, 14 nt, Homo sapiens
gccagguaccuucu

SEQ ID NO: 38865 - RNA, 14 nt, Homo sapiens
ugccugcccugaaa

SEQ ID NO: 38866 - RNA, 13 nt, Homo sapiens
acuaggugcugca

SEQ ID NO: 38867 - RNA, 15 nt, Homo sapiens
ccugagacacauggg

SEQ ID NO: 38868 - RNA, 22 nt, Homo sapiens
ucugccugcccugaaaguccca

SEQ ID NO: 38869 - RNA, 23 nt, Homo sapiens
uaccaugaugcugagcccggaaa

SEQ ID NO: 38870 - RNA, 19 nt, Homo sapiens
aacuauaaaacuaggugcu

SEQ ID NO: 38871 - RNA, 20 nt, Homo sapiens
uaaaacaccucagcugccuc

SEQ ID NO: 38872 - RNA, 19 nt, Homo sapiens
acuccacuuggacaugggc

SEQ ID NO: 38873 - RNA, 21 nt, Homo sapiens
gcccugaaagucccagaucaa

SEQ ID NO: 38874 - RNA, 18 nt, Homo sapiens
cugagcccggaaacucca

SEQ ID NO: 38875 - RNA, 14 nt, Homo sapiens
uuccaaugacauuu

SEQ ID NO: 38876 - RNA, 16 nt, Homo sapiens
cagaucaagccugccu

SEQ ID NO: 38877 - RNA, 16 nt, Homo sapiens
agggaagggggaacau

SEQ ID NO: 38878 - RNA, 17 nt, Homo sapiens
caauaaaacuuuuccaa

SEQ ID NO: 38879 - RNA, 20 nt, Homo sapiens
ugagccuuuguugcuaucaa

SEQ ID NO: 38880 - RNA, 14 nt, Homo sapiens
gcagacucugguca

SEQ ID NO: 38881 - RNA, 16 nt, Homo sapiens
aggagcucccaggagg

SEQ ID NO: 38882 - RNA, 21 nt, Homo sapiens
uagaauucacuccacuuggac

SEQ ID NO: 38883 - RNA, 18 nt, Homo sapiens
agcucuaucccaaccucu

SEQ ID NO: 38884 - RNA, 12 nt, Homo sapiens
acuccacauccu

SEQ ID NO: 38885 - RNA, 12 nt, Homo sapiens
augggccccaga

SEQ ID NO: 38886 - RNA, 21 nt, Homo sapiens
uuucuuccuuuuuuaguucuu

SEQ ID NO: 38887 - RNA, 15 nt, Homo sapiens
ucccaggaggggcuu

SEQ ID NO: 38888 - RNA, 23 nt, Homo sapiens
cuccugagacacaugggugcuau

SEQ ID NO: 38889 - RNA, 15 nt, Homo sapiens
gcccggaaacuccac

SEQ ID NO: 38890 - RNA, 17 nt, Homo sapiens
caaaggcuccugagaca

SEQ ID NO: 38891 - RNA, 23 nt, Homo sapiens
uucccagcuagaauucacuccac

SEQ ID NO: 38892 - RNA, 16 nt, Homo sapiens
accaggcacccccaga

SEQ ID NO: 38893 - RNA, 15 nt, Homo sapiens
agcccggaaacucca

SEQ ID NO: 38894 - RNA, 19 nt, Homo sapiens
uuggauacuccauggggug

SEQ ID NO: 38895 - RNA, 19 nt, Homo sapiens
cagccuuggauacuccaug

SEQ ID NO: 38896 - RNA, 17 nt, Homo sapiens
gccuuggauacuccaug

SEQ ID NO: 38897 - RNA, 20 nt, Homo sapiens
gcccugaaagucccagauca

SEQ ID NO: 38898 - RNA, 22 nt, Homo sapiens
cuuuguugcuaucaauccaaga

SEQ ID NO: 38899 - RNA, 16 nt, Homo sapiens
uaucaauccaagaacu

SEQ ID NO: 38900 - RNA, 21 nt, Homo sapiens
acuuggacaugggccccagau

SEQ ID NO: 38901 - RNA, 20 nt, Homo sapiens
auucauauuuauagccaggu

SEQ ID NO: 38902 - RNA, 14 nt, Homo sapiens
caccugugagacca

SEQ ID NO: 38903 - RNA, 20 nt, Homo sapiens
acacuaaaacaccucagcug

SEQ ID NO: 38904 - RNA, 20 nt, Homo sapiens
cccagaucaagccugccuca

SEQ ID NO: 38905 - RNA, 18 nt, Homo sapiens
cagcuagaauucacucca

SEQ ID NO: 38906 - RNA, 14 nt, Homo sapiens
ugagcggaccuucc

SEQ ID NO: 38907 - RNA, 14 nt, Homo sapiens
cugccugcccugaa

SEQ ID NO: 38908 - RNA, 18 nt, Homo sapiens
cagugaggcggauugaga

SEQ ID NO: 38909 - RNA, 16 nt, Homo sapiens
ugagguaccagccuug

SEQ ID NO: 38910 - RNA, 10 nt, Homo sapiens
ggacaugggc

SEQ ID NO: 38911 - RNA, 20 nt, Homo sapiens
aaacuuuuccaaugacauuu

SEQ ID NO: 38912 - RNA, 21 nt, Homo sapiens
caacuauaaaacuaggugcug

SEQ ID NO: 38913 - RNA, 10 nt, Homo sapiens
cauccaaagg

SEQ ID NO: 38914 - RNA, 16 nt, Homo sapiens
ugagccuuuguugcua

SEQ ID NO: 38915 - RNA, 17 nt, Homo sapiens
gcuccugagacacaugg

SEQ ID NO: 38916 - RNA, 20 nt, Homo sapiens
cugagcccggaaacuccaca

SEQ ID NO: 38917 - RNA, 16 nt, Homo sapiens
uuauagccagguaccu

SEQ ID NO: 38918 - RNA, 13 nt, Homo sapiens
accuucccagcua

SEQ ID NO: 38919 - RNA, 19 nt, Homo sapiens
acucuggucaagaagcauc

SEQ ID NO: 38920 - RNA, 21 nt, Homo sapiens
gaacaugagccuuuguugcua

SEQ ID NO: 38921 - RNA, 21 nt, Homo sapiens
cugugagaccaaauugagcua

SEQ ID NO: 38922 - RNA, 16 nt, Homo sapiens
cuagaauucacuccac

SEQ ID NO: 38923 - RNA, 23 nt, Homo sapiens
agcccucuucugacacuaaaaca

SEQ ID NO: 38924 - RNA, 14 nt, Homo sapiens
acacuaaaacaccu

SEQ ID NO: 38925 - RNA, 14 nt, Homo sapiens
uaaaacuaggugcu

SEQ ID NO: 38926 - RNA, 21 nt, Homo sapiens
agaucaagccugccucaauca

SEQ ID NO: 38927 - RNA, 19 nt, Homo sapiens
gcuccugagacacaugggu

SEQ ID NO: 38928 - RNA, 16 nt, Homo sapiens
ugcagccccugggacc

SEQ ID NO: 38929 - RNA, 21 nt, Homo sapiens
gaaacuccacauccuguggga

SEQ ID NO: 38930 - RNA, 17 nt, Homo sapiens
agccagguaccuucuca

SEQ ID NO: 38931 - RNA, 20 nt, Homo sapiens
gagcggaccuucccagcuag

SEQ ID NO: 38932 - RNA, 17 nt, Homo sapiens
cagauaccaugaugcug

SEQ ID NO: 38933 - RNA, 17 nt, Homo sapiens
gaccugggccauaguca

SEQ ID NO: 38934 - RNA, 20 nt, Homo sapiens
accuucccagcuagaauuca

SEQ ID NO: 38935 - RNA, 21 nt, Homo sapiens
ugagcuaggggggucagccag

SEQ ID NO: 38936 - RNA, 19 nt, Homo sapiens
ccagccuuggauacuccau

SEQ ID NO: 38937 - RNA, 18 nt, Homo sapiens
gauugagaaggagcuccc

SEQ ID NO: 38938 - RNA, 19 nt, Homo sapiens
auaaaacuuuuccaaugac

SEQ ID NO: 38939 - RNA, 23 nt, Homo sapiens
agguaccuucucaccugugagac

SEQ ID NO: 38940 - RNA, 20 nt, Homo sapiens
uucccagcuagaauucacuc

SEQ ID NO: 38941 - RNA, 20 nt, Homo sapiens
cuccauggggugggggugga

SEQ ID NO: 38942 - RNA, 18 nt, Homo sapiens
cugcagccccugggacca

SEQ ID NO: 38943 - RNA, 17 nt, Homo sapiens
gccucaaucaguauuca

SEQ ID NO: 38944 - RNA, 17 nt, Homo sapiens
ugaaagucccagaucaa

SEQ ID NO: 38945 - RNA, 10 nt, Homo sapiens
acccccagaa

SEQ ID NO: 38946 - RNA, 13 nt, Homo sapiens
aauucacuccacu

SEQ ID NO: 38947 - RNA, 14 nt, Homo sapiens
agcccucuucugac

SEQ ID NO: 38948 - RNA, 15 nt, Homo sapiens
uuaguucuucaaaga

SEQ ID NO: 38949 - RNA, 23 nt, Homo sapiens
gaccuucccagcuagaauucacu

SEQ ID NO: 38950 - RNA, 16 nt, Homo sapiens
agccuuggauacucca

SEQ ID NO: 38951 - RNA, 19 nt, Homo sapiens
gaaacuccacauccugugg

SEQ ID NO: 38952 - RNA, 14 nt, Homo sapiens
auccugugggaccu

SEQ ID NO: 38953 - RNA, 23 nt, Homo sapiens
ucccagcuagaauucacuccacu

SEQ ID NO: 38954 - RNA, 13 nt, Homo sapiens
ccgugugccugag

SEQ ID NO: 38955 - RNA, 15 nt, Homo sapiens
gauaccaugaugcug

SEQ ID NO: 38956 - RNA, 14 nt, Homo sapiens
cagaccgggguucc

SEQ ID NO: 38957 - RNA, 21 nt, Homo sapiens
aggauggcaggaggcauccaa

SEQ ID NO: 38958 - RNA, 17 nt, Homo sapiens
agcuagaauucacucca

SEQ ID NO: 38959 - RNA, 13 nt, Homo sapiens
ugcuaucaaucca

SEQ ID NO: 38960 - RNA, 20 nt, Homo sapiens
aaacuccacauccuguggga

SEQ ID NO: 38961 - RNA, 14 nt, Homo sapiens
cagauaccaugaug

SEQ ID NO: 38962 - RNA, 17 nt, Homo sapiens
ucaauccaagaacuuau

SEQ ID NO: 38963 - RNA, 21 nt, Homo sapiens
ggccccagauaccaugaugcu

SEQ ID NO: 38964 - RNA, 15 nt, Homo sapiens
cagccccugggacca

SEQ ID NO: 38965 - RNA, 17 nt, Homo sapiens
cucuaucccaaccucuc

SEQ ID NO: 38966 - RNA, 20 nt, Homo sapiens
acauuuuuuuuuucaauaaa

SEQ ID NO: 38967 - RNA, 17 nt, Homo sapiens
ugggccauagucauucu

SEQ ID NO: 38968 - RNA, 15 nt, Homo sapiens
uccugagacacaugg

SEQ ID NO: 38969 - RNA, 22 nt, Homo sapiens
cccaacuauaaaacuaggugcu

SEQ ID NO: 38970 - RNA, 18 nt, Homo sapiens
gacaugggccccagauac

SEQ ID NO: 38971 - RNA, 18 nt, Homo sapiens
agccagguaccuucucac

SEQ ID NO: 38972 - RNA, 19 nt, Homo sapiens
cugcagccccugggaccag

SEQ ID NO: 38973 - RNA, 17 nt, Homo sapiens
cagaucaagccugccuc

SEQ ID NO: 38974 - RNA, 23 nt, Homo sapiens
ggaacaugagccuuuguugcuau

SEQ ID NO: 38975 - RNA, 19 nt, Homo sapiens
acaugagccuuuguugcua

SEQ ID NO: 38976 - RNA, 22 nt, Homo sapiens
cagcugccuccccagcucuauc

SEQ ID NO: 38977 - RNA, 15 nt, Homo sapiens
aagucccagaucaag

SEQ ID NO: 38978 - RNA, 17 nt, Homo sapiens
uguugcuaucaauccaa

SEQ ID NO: 38979 - RNA, 22 nt, Homo sapiens
uaccagccuuggauacuccaug

SEQ ID NO: 38980 - RNA, 18 nt, Homo sapiens
cugccuccccagcucuau

SEQ ID NO: 38981 - RNA, 22 nt, Homo sapiens
uugggggggaggugagguacca

SEQ ID NO: 38982 - RNA, 22 nt, Homo sapiens
ucccaggaggggcuucugggca

SEQ ID NO: 38983 - RNA, 21 nt, Homo sapiens
uuuucaauaaaacuuuuccaa

SEQ ID NO: 38984 - RNA, 17 nt, Homo sapiens
uggcaggaggcauccaa

SEQ ID NO: 38985 - RNA, 19 nt, Homo sapiens
uccacauccugugggaccu

SEQ ID NO: 38986 - RNA, 18 nt, Homo sapiens
ggugagguaccagccuug

SEQ ID NO: 38987 - RNA, 14 nt, Homo sapiens
gaacaugagccuuu

SEQ ID NO: 38988 - RNA, 16 nt, Homo sapiens
cauccugugggaccug

SEQ ID NO: 38989 - RNA, 21 nt, Homo sapiens
cccagcuagaauucacuccac

SEQ ID NO: 38990 - RNA, 18 nt, Homo sapiens
gagacacaugggugcuau

SEQ ID NO: 38991 - RNA, 20 nt, Homo sapiens
cuucccagcuagaauucacu

SEQ ID NO: 38992 - RNA, 13 nt, Homo sapiens
ccggaaacuccac

SEQ ID NO: 38993 - RNA, 19 nt, Homo sapiens
cugagacacaugggugcua

SEQ ID NO: 38994 - RNA, 15 nt, Homo sapiens
aaagucccagaucaa

SEQ ID NO: 38995 - RNA, 20 nt, Homo sapiens
ccccagauaccaugaugcug

SEQ ID NO: 38996 - RNA, 20 nt, Homo sapiens
ccugagacacaugggugcua

SEQ ID NO: 38997 - RNA, 17 nt, Homo sapiens
augagccuuuguugcua

SEQ ID NO: 38998 - RNA, 16 nt, Homo sapiens
ccucucccaacuauaa

SEQ ID NO: 38999 - RNA, 12 nt, Homo sapiens
cgugugccugag

SEQ ID NO: 39000 - RNA, 14 nt, Homo sapiens
ugcuaucaauccaa

SEQ ID NO: 39001 - RNA, 17 nt, Homo sapiens
ucagcugccuccccagc

SEQ ID NO: 39002 - RNA, 22 nt, Homo sapiens
aaggcuccugagacacaugggu

SEQ ID NO: 39003 - RNA, 21 nt, Homo sapiens
ccaugaugcugagcccggaaa

SEQ ID NO: 39004 - RNA, 21 nt, Homo sapiens
cagcccucuucugacacuaaa

SEQ ID NO: 39005 - RNA, 12 nt, Homo sapiens
gcggaccuuccc

SEQ ID NO: 39006 - RNA, 14 nt, Homo sapiens
ucacuccacuugga

SEQ ID NO: 39007 - RNA, 16 nt, Homo sapiens
ucaaucaguauucaua

SEQ ID NO: 39008 - RNA, 22 nt, Homo sapiens
ucagccagcccucuucugacac

SEQ ID NO: 39009 - RNA, 16 nt, Homo sapiens
ggcuccugagacacau

SEQ ID NO: 39010 - RNA, 16 nt, Homo sapiens
aacuauaaaacuaggu

SEQ ID NO: 39011 - RNA, 22 nt, Homo sapiens
agccuuggauacuccauggggu

SEQ ID NO: 39012 - RNA, 17 nt, Homo sapiens
agcccggaaacuccaca

SEQ ID NO: 39013 - RNA, 17 nt, Homo sapiens
gaauucacuccacuugg

SEQ ID NO: 39014 - RNA, 16 nt, Homo sapiens
aacuuuuccaaugaca

SEQ ID NO: 39015 - RNA, 19 nt, Homo sapiens
ugggccccagauaccauga

SEQ ID NO: 39016 - RNA, 18 nt, Homo sapiens
uggagaaaggacccucaa

SEQ ID NO: 39017 - RNA, 14 nt, Homo sapiens
ugugccuucauuuu

SEQ ID NO: 39018 - RNA, 19 nt, Homo sapiens
uucuuaagacgugauuuug

SEQ ID NO: 39019 - RNA, 14 nt, Homo sapiens
uuccaauacauuau

SEQ ID NO: 39020 - RNA, 15 nt, Homo sapiens
uuacuuaguguuaug

SEQ ID NO: 39021 - RNA, 18 nt, Homo sapiens
uuaaauggagaaaggacc

SEQ ID NO: 39022 - RNA, 14 nt, Homo sapiens
uguuuucauuaucu

SEQ ID NO: 39023 - RNA, 16 nt, Homo sapiens
uccccagcuguuuaug

SEQ ID NO: 39024 - RNA, 17 nt, Homo sapiens
guaagggaaacugccag

SEQ ID NO: 39025 - RNA, 19 nt, Homo sapiens
gguuuuucaguuuucagga

SEQ ID NO: 39026 - RNA, 12 nt, Homo sapiens
gcagggacagga

SEQ ID NO: 39027 - RNA, 18 nt, Homo sapiens
gcauauugauaauaaaau

SEQ ID NO: 39028 - RNA, 11 nt, Homo sapiens
gaacauaaaau

SEQ ID NO: 39029 - RNA, 15 nt, Homo sapiens
gaauacuaauaaaau

SEQ ID NO: 39030 - RNA, 19 nt, Homo sapiens
gaacguuuuuccuguucuu

SEQ ID NO: 39031 - RNA, 21 nt, Homo sapiens
gcaccuuuagaauauuaaaaa

SEQ ID NO: 39032 - RNA, 11 nt, Homo sapiens
caacacgagca

SEQ ID NO: 39033 - RNA, 13 nt, Homo sapiens
aguaaaaccacag

SEQ ID NO: 39034 - RNA, 19 nt, Homo sapiens
aggugcuacaaaaacacag

SEQ ID NO: 39035 - RNA, 20 nt, Homo sapiens
augacccccaucccaugggg

SEQ ID NO: 39036 - RNA, 21 nt, Homo sapiens
augacccccaucccauggggg

SEQ ID NO: 39037 - RNA, 17 nt, Homo sapiens
agcaaauuccaauacau

SEQ ID NO: 39038 - RNA, 19 nt, Homo sapiens
uuugugaagaaacauuuau

SEQ ID NO: 39039 - RNA, 13 nt, Homo sapiens
uuggacucauuuu

SEQ ID NO: 39040 - RNA, 15 nt, Homo sapiens
ugugccuucauuuuu

SEQ ID NO: 39041 - RNA, 17 nt, Homo sapiens
uggagaaaggacccuca

SEQ ID NO: 39042 - RNA, 18 nt, Homo sapiens
acaguuuuuauugcuugu

SEQ ID NO: 39043 - RNA, 17 nt, Homo sapiens
uucuauggcauauugau

SEQ ID NO: 39044 - RNA, 17 nt, Homo sapiens
uuaaauggagaaaggac

SEQ ID NO: 39045 - RNA, 22 nt, Homo sapiens
cuagaauacuaauaaaauacau

SEQ ID NO: 39046 - RNA, 19 nt, Homo sapiens
cuacaguguacagucuugu

SEQ ID NO: 39047 - RNA, 16 nt, Homo sapiens
cuacaaaaacacagca

SEQ ID NO: 39048 - RNA, 21 nt, Homo sapiens
cuuaguugcuguaugucucgu

SEQ ID NO: 39049 - RNA, 11 nt, Homo sapiens
cauauuaaaau

SEQ ID NO: 39050 - RNA, 15 nt, Homo sapiens
ccaacacgagcaggc

SEQ ID NO: 39051 - RNA, 12 nt, Homo sapiens
ucaaaacugcac

SEQ ID NO: 39052 - RNA, 12 nt, Homo sapiens
uauuucauuucu

SEQ ID NO: 39053 - RNA, 13 nt, Homo sapiens
uauuucauuucuu

SEQ ID NO: 39054 - RNA, 20 nt, Homo sapiens
uauuguuuaaaaucauuucu

SEQ ID NO: 39055 - RNA, 20 nt, Homo sapiens
guucacagccagacuggcac

SEQ ID NO: 39056 - RNA, 13 nt, Homo sapiens
uaaaacucauuuu

SEQ ID NO: 39057 - RNA, 14 nt, Homo sapiens
uaaaacucauuuuu

SEQ ID NO: 39058 - RNA, 16 nt, Homo sapiens
gugucuuaauuaaaag

SEQ ID NO: 39059 - RNA, 21 nt, Homo sapiens
gucuuguguuucuuuaguuuu

SEQ ID NO: 39060 - RNA, 22 nt, Homo sapiens
gucuuguguuucuuuaguuuuu

SEQ ID NO: 39061 - RNA, 18 nt, Homo sapiens
guaagggaaacugccagc

SEQ ID NO: 39062 - RNA, 13 nt, Homo sapiens
gguugauuucagc

SEQ ID NO: 39063 - RNA, 23 nt, Homo sapiens
ggucggguuuuauuguuuaaaau

SEQ ID NO: 39064 - RNA, 23 nt, Homo sapiens
gcucaacaagagacuggaaggac

SEQ ID NO: 39065 - RNA, 14 nt, Homo sapiens
aauguagauaaagc

SEQ ID NO: 39066 - RNA, 18 nt, Homo sapiens
aaucauaugggauacugc

SEQ ID NO: 39067 - RNA, 21 nt, Homo sapiens
cuuguuggauuuuugucuugu

SEQ ID NO: 39068 - RNA, 21 nt, Homo sapiens
cuucuaaguaaaaccacagca

SEQ ID NO: 39069 - RNA, 16 nt, Homo sapiens
cuacauacuauggaau

SEQ ID NO: 39070 - RNA, 20 nt, Homo sapiens
cucauuuuaaaaaauggaac

SEQ ID NO: 39071 - RNA, 22 nt, Homo sapiens
gcaccuuuagaauauuaaaaau

SEQ ID NO: 39072 - RNA, 15 nt, Homo sapiens
gaugaucuuuaaaau

SEQ ID NO: 39073 - RNA, 19 nt, Homo sapiens
gaccuguggccaaguucuu

SEQ ID NO: 39074 - RNA, 15 nt, Homo sapiens
acaacucgaaucacu

SEQ ID NO: 39075 - RNA, 15 nt, Homo sapiens
aaccccaucauccuc

SEQ ID NO: 39076 - RNA, 14 nt, Homo sapiens
aacaacucgaauca

SEQ ID NO: 39077 - RNA, 15 nt, Homo sapiens
aaauauuuguaucac

SEQ ID NO: 39078 - RNA, 19 nt, Homo sapiens
aaaaucauuucugcaucag

SEQ ID NO: 39079 - RNA, 20 nt, Homo sapiens
aaaaucauuucugcaucagc

SEQ ID NO: 39080 - RNA, 12 nt, Homo sapiens
aaaauacauacu

SEQ ID NO: 39081 - RNA, 14 nt, Homo sapiens
aaaauacauacuau

SEQ ID NO: 39082 - RNA, 15 nt, Homo sapiens
aacaacucgaaucac

SEQ ID NO: 39083 - RNA, 15 nt, Homo sapiens
acuaauaaaauacau

SEQ ID NO: 39084 - RNA, 18 nt, Homo sapiens
agcaaauuccaauacauu

SEQ ID NO: 39085 - RNA, 19 nt, Homo sapiens
acaguuuuuauugcuuguu

SEQ ID NO: 39086 - RNA, 14 nt, Homo sapiens
aagcuuauuaaaac

SEQ ID NO: 39087 - RNA, 15 nt, Homo sapiens
aagcuuauuaaaacu

SEQ ID NO: 39088 - RNA, 11 nt, Homo sapiens
aagaugaaaau

SEQ ID NO: 39089 - RNA, 17 nt, Homo sapiens
aaguaugcacuaaucaa

SEQ ID NO: 39090 - RNA, 23 nt, Homo sapiens
aagggaacugaacauuccagagc

SEQ ID NO: 39091 - RNA, 22 nt, Homo sapiens
aagugguauagaaaugcugguu

SEQ ID NO: 39092 - RNA, 18 nt, Homo sapiens
aaggaguccuugcaucaa

SEQ ID NO: 39093 - RNA, 15 nt, Homo sapiens
caaauuccaauacau

SEQ ID NO: 39094 - RNA, 21 nt, Homo sapiens
caagcaggcucaacauaacau

SEQ ID NO: 39095 - RNA, 14 nt, Homo sapiens
caacaaauaggaau

SEQ ID NO: 39096 - RNA, 20 nt, Homo sapiens
cauagauucccugagcagga

SEQ ID NO: 39097 - RNA, 20 nt, Homo sapiens
aauacugauguuccuaguga

SEQ ID NO: 39098 - RNA, 14 nt, Homo sapiens
uaaaaccacagcag

SEQ ID NO: 39099 - RNA, 14 nt, Homo sapiens
ucucuucuuuaaag

SEQ ID NO: 39100 - RNA, 16 nt, Homo sapiens
aagaggcagcuugaaa

SEQ ID NO: 39101 - RNA, 23 nt, Homo sapiens
gcaacgcaggcccccaggugcca

SEQ ID NO: 39102 - RNA, 14 nt, Homo sapiens
aaaugugccuucau

SEQ ID NO: 39103 - RNA, 16 nt, Homo sapiens
guaaaaccacagcagu

SEQ ID NO: 39104 - RNA, 17 nt, Homo sapiens
acaacucgaaucacuca

SEQ ID NO: 39105 - RNA, 12 nt, Homo sapiens
aaacucauccau

SEQ ID NO: 39106 - RNA, 21 nt, Homo sapiens
cuauugugcuuucuaucuaau

SEQ ID NO: 39107 - RNA, 14 nt, Homo sapiens
augaugaugaucuu

SEQ ID NO: 39108 - RNA, 14 nt, Homo sapiens
gaugugaacacauc

SEQ ID NO: 39109 - RNA, 19 nt, Homo sapiens
caggaaaucaaauaugcaa

SEQ ID NO: 39110 - RNA, 15 nt, Homo sapiens
cuggcacaguuuucu

SEQ ID NO: 39111 - RNA, 19 nt, Homo sapiens
caaaauaccaugccauuua

SEQ ID NO: 39112 - RNA, 14 nt, Homo sapiens
aagacuauucaaac

SEQ ID NO: 39113 - RNA, 20 nt, Homo sapiens
acagcaagggugaugggaaa

SEQ ID NO: 39114 - RNA, 19 nt, Homo sapiens
ucauuaucucaaaacugca

SEQ ID NO: 39115 - RNA, 21 nt, Homo sapiens
agcugcugaaacaacaaauag

SEQ ID NO: 39116 - RNA, 21 nt, Homo sapiens
agacgugauuuugcuguagaa

SEQ ID NO: 39117 - RNA, 14 nt, Homo sapiens
caggaaaucaaaua

SEQ ID NO: 39118 - RNA, 20 nt, Homo sapiens
guaugcacuaaucaauacuu

SEQ ID NO: 39119 - RNA, 22 nt, Homo sapiens
uauuuccauauuaaaaucacaa

SEQ ID NO: 39120 - RNA, 23 nt, Homo sapiens
aagaggcagcuugaaacugagau

SEQ ID NO: 39121 - RNA, 20 nt, Homo sapiens
ucauauugaugugugucuag

SEQ ID NO: 39122 - RNA, 22 nt, Homo sapiens
uaaguagggacuucugucuuca

SEQ ID NO: 39123 - RNA, 14 nt, Homo sapiens
uuuucauuaucuca

SEQ ID NO: 39124 - RNA, 20 nt, Homo sapiens
caucagcugcugaaacaaca

SEQ ID NO: 39125 - RNA, 22 nt, Homo sapiens
gcacuaaucaauacuuugaaca

SEQ ID NO: 39126 - RNA, 22 nt, Homo sapiens
aguaugcacuaaucaauacuuu

SEQ ID NO: 39127 - RNA, 23 nt, Homo sapiens
agaaagacuauucaaacagucuc

SEQ ID NO: 39128 - RNA, 16 nt, Homo sapiens
ucacguaaagcuagaa

SEQ ID NO: 39129 - RNA, 20 nt, Homo sapiens
auuucauaccuaucaucuua

SEQ ID NO: 39130 - RNA, 23 nt, Homo sapiens
uuuuauggaggcuuugcauagau

SEQ ID NO: 39131 - RNA, 21 nt, Homo sapiens
uacuuugaacacaaagccugu

SEQ ID NO: 39132 - RNA, 19 nt, Homo sapiens
ucacaaaucuuaacuugaa

SEQ ID NO: 39133 - RNA, 23 nt, Homo sapiens
uaaaaguacauguuaaacuuacu

SEQ ID NO: 39134 - RNA, 13 nt, Homo sapiens
uucacagccagac

SEQ ID NO: 39135 - RNA, 11 nt, Homo sapiens
uuugcuguaga

SEQ ID NO: 39136 - RNA, 23 nt, Homo sapiens
cuauaggugcuacaaaaacacag

SEQ ID NO: 39137 - RNA, 20 nt, Homo sapiens
aauuucucccagucauuuaa

SEQ ID NO: 39138 - RNA, 13 nt, Homo sapiens
ucauuuauuucca

SEQ ID NO: 39139 - RNA, 14 nt, Homo sapiens
uagauaaagcacug

SEQ ID NO: 39140 - RNA, 19 nt, Homo sapiens
uucuaaguaaaaccacagc

SEQ ID NO: 39141 - RNA, 15 nt, Homo sapiens
caaauaugcaaagca

SEQ ID NO: 39142 - RNA, 13 nt, Homo sapiens
ugcaaagcacuga

SEQ ID NO: 39143 - RNA, 13 nt, Homo sapiens
gauaaagcacugu

SEQ ID NO: 39144 - RNA, 16 nt, Homo sapiens
ucuuaaguagggacuu

SEQ ID NO: 39145 - RNA, 22 nt, Homo sapiens
uaugagauguagcaaauuccaa

SEQ ID NO: 39146 - RNA, 18 nt, Homo sapiens
aggugcuacaaaaacaca

SEQ ID NO: 39147 - RNA, 15 nt, Homo sapiens
ugcuuucuaucuaau

SEQ ID NO: 39148 - RNA, 16 nt, Homo sapiens
cccaaauuucauaccu

SEQ ID NO: 39149 - RNA, 18 nt, Homo sapiens
acgugauuuugcuguaga

SEQ ID NO: 39150 - RNA, 21 nt, Homo sapiens
gcuugcccuguuaaaagauga

SEQ ID NO: 39151 - RNA, 19 nt, Homo sapiens
auuagugaaguaugcacua

SEQ ID NO: 39152 - RNA, 22 nt, Homo sapiens
uagaauacuaauaaaauacaua

SEQ ID NO: 39153 - RNA, 12 nt, Homo sapiens
ggauaugagaug

SEQ ID NO: 39154 - RNA, 22 nt, Homo sapiens
uuaaguuacacauuuuucagau

SEQ ID NO: 39155 - RNA, 14 nt, Homo sapiens
gaacacaucagcuu

SEQ ID NO: 39156 - RNA, 15 nt, Homo sapiens
acuauucaaacaguc

SEQ ID NO: 39157 - RNA, 15 nt, Homo sapiens
cuuacuuaguguuau

SEQ ID NO: 39158 - RNA, 14 nt, Homo sapiens
guagcaaauuccaa

SEQ ID NO: 39159 - RNA, 22 nt, Homo sapiens
aauguaagggaaacugccagca

SEQ ID NO: 39160 - RNA, 12 nt, Homo sapiens
aggacuguagaa

SEQ ID NO: 39161 - RNA, 14 nt, Homo sapiens
ccuuuagaauauua

SEQ ID NO: 39162 - RNA, 20 nt, Homo sapiens
uacacauuuuucagauauaa

SEQ ID NO: 39163 - RNA, 14 nt, Homo sapiens
aucucaaaacugca

SEQ ID NO: 39164 - RNA, 17 nt, Homo sapiens
uggcacuuauaaccaaa

SEQ ID NO: 39165 - RNA, 14 nt, Homo sapiens
aauacuuugaacac

SEQ ID NO: 39166 - RNA, 23 nt, Homo sapiens
auguagcaaauuccaauacauua

SEQ ID NO: 39167 - RNA, 15 nt, Homo sapiens
aauaaaauacauacu

SEQ ID NO: 39168 - RNA, 23 nt, Homo sapiens
aagaaauguaagggaaacugcca

SEQ ID NO: 39169 - RNA, 19 nt, Homo sapiens
aaaucaaauaugcaaagca

SEQ ID NO: 39170 - RNA, 11 nt, Homo sapiens
aguugcuguau

SEQ ID NO: 39171 - RNA, 18 nt, Homo sapiens
ugaaguuuaauugacuua

SEQ ID NO: 39172 - RNA, 13 nt, Homo sapiens
aagacuccaaaga

SEQ ID NO: 39173 - RNA, 19 nt, Homo sapiens
ggagaaaggacccucaaga

SEQ ID NO: 39174 - RNA, 17 nt, Homo sapiens
uguagauaaagcacugu

SEQ ID NO: 39175 - RNA, 16 nt, Homo sapiens
ccagacuggcacaguu

SEQ ID NO: 39176 - RNA, 16 nt, Homo sapiens
ugaaguuuaauugacu

SEQ ID NO: 39177 - RNA, 22 nt, Homo sapiens
uuugaacaacucgaaucacuca

SEQ ID NO: 39178 - RNA, 18 nt, Homo sapiens
cugagaaagacuauucaa

SEQ ID NO: 39179 - RNA, 19 nt, Homo sapiens
ugaccaauauuguacaguu

SEQ ID NO: 39180 - RNA, 12 nt, Homo sapiens
uguguuacugau

SEQ ID NO: 39181 - RNA, 18 nt, Homo sapiens
aucuuuaaaauacacacu

SEQ ID NO: 39182 - RNA, 16 nt, Homo sapiens
gaacugaacauuccag

SEQ ID NO: 39183 - RNA, 23 nt, Homo sapiens
aagacgugauuuugcuguagaag

SEQ ID NO: 39184 - RNA, 16 nt, Homo sapiens
caauauuguacaguuu

SEQ ID NO: 39185 - RNA, 19 nt, Homo sapiens
gcaaccccaucauccucag

SEQ ID NO: 39186 - RNA, 19 nt, Homo sapiens
uaauaaaauacauacuaua

SEQ ID NO: 39187 - RNA, 21 nt, Homo sapiens
agaaaggacccucaagacaaa

SEQ ID NO: 39188 - RNA, 18 nt, Homo sapiens
cuaaguaaaaccacagca

SEQ ID NO: 39189 - RNA, 15 nt, Homo sapiens
ucacaaacucaucca

SEQ ID NO: 39190 - RNA, 16 nt, Homo sapiens
aauuccaauacauuau

SEQ ID NO: 39191 - RNA, 14 nt, Homo sapiens
uacaaaaacacagc

SEQ ID NO: 39192 - RNA, 21 nt, Homo sapiens
auaacuuuuuuuuaaguuaca

SEQ ID NO: 39193 - RNA, 14 nt, Homo sapiens
accuacaguguaca

SEQ ID NO: 39194 - RNA, 13 nt, Homo sapiens
aggacuguagaaa

SEQ ID NO: 39195 - RNA, 21 nt, Homo sapiens
uauagauucuuuauuagugaa

SEQ ID NO: 39196 - RNA, 18 nt, Homo sapiens
ggagaagagcuguucaca

SEQ ID NO: 39197 - RNA, 22 nt, Homo sapiens
uaaccaaagcccaaagugguau

SEQ ID NO: 39198 - RNA, 22 nt, Homo sapiens
auuuuaacuuccuuggacucau

SEQ ID NO: 39199 - RNA, 20 nt, Homo sapiens
cagcuguuuaugcauagaua

SEQ ID NO: 39200 - RNA, 13 nt, Homo sapiens
uaaaaaauggaac

SEQ ID NO: 39201 - RNA, 14 nt, Homo sapiens
acucauccauuaau

SEQ ID NO: 39202 - RNA, 21 nt, Homo sapiens
cucggagaagagcuguucaca

SEQ ID NO: 39203 - RNA, 18 nt, Homo sapiens
uuuaaaauacacacucaa

SEQ ID NO: 39204 - RNA, 14 nt, Homo sapiens
gagcaggcuacugu

SEQ ID NO: 39205 - RNA, 23 nt, Homo sapiens
guugauuucagcaccuacagugu

SEQ ID NO: 39206 - RNA, 18 nt, Homo sapiens
cugagaugugaacacauc

SEQ ID NO: 39207 - RNA, 22 nt, Homo sapiens
ccguuuugugaagaaacauuua

SEQ ID NO: 39208 - RNA, 12 nt, Homo sapiens
ugaacauuccag

SEQ ID NO: 39209 - RNA, 18 nt, Homo sapiens
cuaauaaaauacauacua

SEQ ID NO: 39210 - RNA, 15 nt, Homo sapiens
aggauaagagggauu

SEQ ID NO: 39211 - RNA, 23 nt, Homo sapiens
acucauuuuuguuuucauuaucu

SEQ ID NO: 39212 - RNA, 14 nt, Homo sapiens
cagccagacuggca

SEQ ID NO: 39213 - RNA, 18 nt, Homo sapiens
auuucauaccuaucaucu

SEQ ID NO: 39214 - RNA, 17 nt, Homo sapiens
auuaaaaucacaaacuc

SEQ ID NO: 39215 - RNA, 16 nt, Homo sapiens
aauaaaugugccuuca

SEQ ID NO: 39216 - RNA, 16 nt, Homo sapiens
ugaacacaaagccugu

SEQ ID NO: 39217 - RNA, 17 nt, Homo sapiens
guaagggaaacugccag

SEQ ID NO: 39218 - RNA, 23 nt, Homo sapiens
caacacgagcaggcuacugucag

SEQ ID NO: 39219 - RNA, 14 nt, Homo sapiens
aaaauacauacuau

SEQ ID NO: 39220 - RNA, 12 nt, Homo sapiens
ccaauacauuau

SEQ ID NO: 39221 - RNA, 20 nt, Homo sapiens
cugaccaauauuguacaguu

SEQ ID NO: 39222 - RNA, 15 nt, Homo sapiens
uaaucaauacuuuga

SEQ ID NO: 39223 - RNA, 15 nt, Homo sapiens
ccuguguuacugauu

SEQ ID NO: 39224 - RNA, 15 nt, Homo sapiens
cugaccaauauugua

SEQ ID NO: 39225 - RNA, 15 nt, Homo sapiens
aauuucucccaguca

SEQ ID NO: 39226 - RNA, 17 nt, Homo sapiens
acucauuuuuguuuuca

SEQ ID NO: 39227 - RNA, 20 nt, Homo sapiens
gugcuuuuaaaaaaaaauac

SEQ ID NO: 39228 - RNA, 18 nt, Homo sapiens
uguagaagauggcacuua

SEQ ID NO: 39229 - RNA, 14 nt, Homo sapiens
aaguagggacuucu

SEQ ID NO: 39230 - RNA, 21 nt, Homo sapiens
auuauucccauucuacauacu

SEQ ID NO: 39231 - RNA, 24 nt, Homo sapiens
auauuaaaaucacaaacucaucca

SEQ ID NO: 39232 - RNA, 21 nt, Homo sapiens
cucauuuauuuccauauuaaa

SEQ ID NO: 39233 - RNA, 15 nt, Homo sapiens
aagauagcagggcau

SEQ ID NO: 39234 - RNA, 19 nt, Homo sapiens
uaauguagauaaagcacug

SEQ ID NO: 39235 - RNA, 18 nt, Homo sapiens
ugguuuuucaguuuucag

SEQ ID NO: 39236 - RNA, 14 nt, Homo sapiens
agaaagacuauuca

SEQ ID NO: 39237 - RNA, 13 nt, Homo sapiens
aauuagaugacug

SEQ ID NO: 39238 - RNA, 14 nt, Homo sapiens
ccaaagugguauag

SEQ ID NO: 39239 - RNA, 16 nt, Homo sapiens
ucaauacuuugaacac

SEQ ID NO: 39240 - RNA, 11 nt, Homo sapiens
uugcuguagaa

SEQ ID NO: 39241 - RNA, 20 nt, Homo sapiens
aauguaagggaaacugccag

SEQ ID NO: 39242 - RNA, 16 nt, Homo sapiens
uuaccuuuguucccaa

SEQ ID NO: 39243 - RNA, 14 nt, Homo sapiens
uaagggaaacugcc

SEQ ID NO: 39244 - RNA, 17 nt, Homo sapiens
gcagcuugaaacugaga

SEQ ID NO: 39245 - RNA, 20 nt, Homo sapiens
uuuuauggaggcuuugcaua

SEQ ID NO: 39246 - RNA, 13 nt, Homo sapiens
cuguucacagcca

SEQ ID NO: 39247 - RNA, 13 nt, Homo sapiens
accuuuguuccca

SEQ ID NO: 39248 - RNA, 12 nt, Homo sapiens
aaguaaaaccac

SEQ ID NO: 39249 - RNA, 19 nt, Homo sapiens
agcaccuacaguguacagu

SEQ ID NO: 39250 - RNA, 14 nt, Homo sapiens
ccagacuggcacag

SEQ ID NO: 39251 - RNA, 17 nt, Homo sapiens
augugaacacaucagcu

SEQ ID NO: 39252 - RNA, 20 nt, Homo sapiens
aaucauuucugcaucagcug

SEQ ID NO: 39253 - RNA, 21 nt, Homo sapiens
ugucaagaugaugaugaucuu

SEQ ID NO: 39254 - RNA, 22 nt, Homo sapiens
acagucuuguauuaaguuguua

SEQ ID NO: 39255 - RNA, 23 nt, Homo sapiens
aaggaccauaaauuuaaauggag

SEQ ID NO: 39256 - RNA, 20 nt, Homo sapiens
agcuguuuaugcauagauaa

SEQ ID NO: 39257 - RNA, 14 nt, Homo sapiens
uuucugagaaagac

SEQ ID NO: 39258 - RNA, 19 nt, Homo sapiens
aaauacacacucaaaucaa

SEQ ID NO: 39259 - RNA, 17 nt, Homo sapiens
agaugugggcagugaug

SEQ ID NO: 39260 - RNA, 22 nt, Homo sapiens
uagauaaagcacuguuuggaua

SEQ ID NO: 39261 - RNA, 20 nt, Homo sapiens
uauuagugaaguaugcacua

SEQ ID NO: 39262 - RNA, 22 nt, Homo sapiens
cuaaguaaaaccacagcaguug

SEQ ID NO: 39263 - RNA, 13 nt, Homo sapiens
gugcuacaaaaac

SEQ ID NO: 39264 - RNA, 14 nt, Homo sapiens
caguguacagucuu

SEQ ID NO: 39265 - RNA, 22 nt, Homo sapiens
uugaacaacucgaaucacucau

SEQ ID NO: 39266 - RNA, 22 nt, Homo sapiens
gaugaucuuuaaaauacacacu

SEQ ID NO: 39267 - RNA, 17 nt, Homo sapiens
aggugcuacaaaaacac

SEQ ID NO: 39268 - RNA, 19 nt, Homo sapiens
guuguuaauaaaaguacau

SEQ ID NO: 39269 - RNA, 16 nt, Homo sapiens
ucaaauguuguucucu

SEQ ID NO: 39270 - RNA, 22 nt, Homo sapiens
ccagguagagagaccacaagca

SEQ ID NO: 39271 - RNA, 16 nt, Homo sapiens
uaaaauacacacucaa

SEQ ID NO: 39272 - RNA, 18 nt, Homo sapiens
cugcugaaacaacaaaua

SEQ ID NO: 39273 - RNA, 14 nt, Homo sapiens
ucuuaguugcugua

SEQ ID NO: 39274 - RNA, 18 nt, Homo sapiens
gugcuacaaaaacacagc

SEQ ID NO: 39275 - RNA, 14 nt, Homo sapiens
uuauuggacuucca

SEQ ID NO: 39276 - RNA, 19 nt, Homo sapiens
uuaaauggagaaaggaccc

SEQ ID NO: 39277 - RNA, 22 nt, Homo sapiens
agggacuucugucuucacaaca

SEQ ID NO: 39278 - RNA, 20 nt, Homo sapiens
uacaguuuuuauugcuuguu

SEQ ID NO: 39279 - RNA, 14 nt, Homo sapiens
accaugccauuuaa

SEQ ID NO: 39280 - RNA, 12 nt, Homo sapiens
caaguccaagca

SEQ ID NO: 39281 - RNA, 20 nt, Homo sapiens
uaauguagauaaagcacugu

SEQ ID NO: 39282 - RNA, 22 nt, Homo sapiens
auuuuuguuuucauuaucucaa

SEQ ID NO: 39283 - RNA, 19 nt, Homo sapiens
uuaaaaaaaaauacugaug

SEQ ID NO: 39284 - RNA, 13 nt, Homo sapiens
gcuauaggugcua

SEQ ID NO: 39285 - RNA, 17 nt, Homo sapiens
acacucaaaucaagaaa

SEQ ID NO: 39286 - RNA, 17 nt, Homo sapiens
ggcaggaccuguggcca

SEQ ID NO: 39287 - RNA, 14 nt, Homo sapiens
uauuuguaucacaa

SEQ ID NO: 39288 - RNA, 16 nt, Homo sapiens
uuaucucaaaacugca

SEQ ID NO: 39289 - RNA, 20 nt, Homo sapiens
caaguucuuaguugcuguau

SEQ ID NO: 39290 - RNA, 21 nt, Homo sapiens
uuuaaagcuuauuaaaacuca

SEQ ID NO: 39291 - RNA, 19 nt, Homo sapiens
aaaaucacaaacucaucca

SEQ ID NO: 39292 - RNA, 15 nt, Homo sapiens
guaagggaaacugcc

SEQ ID NO: 39293 - RNA, 13 nt, Homo sapiens
cugagcaggauuu

SEQ ID NO: 39294 - RNA, 14 nt, Homo sapiens
aagggauggcaaga

SEQ ID NO: 39295 - RNA, 14 nt, Homo sapiens
uccuagugaaagag

SEQ ID NO: 39296 - RNA, 14 nt, Homo sapiens
agaagagcuguuca

SEQ ID NO: 39297 - RNA, 15 nt, Homo sapiens
uaaaaccacagcagu

SEQ ID NO: 39298 - RNA, 12 nt, Homo sapiens
auuagaugacug

SEQ ID NO: 39299 - RNA, 16 nt, Homo sapiens
aaaagggaacugaaca

SEQ ID NO: 39300 - RNA, 17 nt, Homo sapiens
cuguaugucucguggua

SEQ ID NO: 39301 - RNA, 21 nt, Homo sapiens
uucauuaucucaaaacugcac

SEQ ID NO: 39302 - RNA, 13 nt, Homo sapiens
uuuugcuguagaa

SEQ ID NO: 39303 - RNA, 18 nt, Homo sapiens
aaauuauauuuugaacaa

SEQ ID NO: 39304 - RNA, 16 nt, Homo sapiens
aacaacucgaaucacu

SEQ ID NO: 39305 - RNA, 18 nt, Homo sapiens
cucaaaacugcacuguca

SEQ ID NO: 39306 - RNA, 21 nt, Homo sapiens
uagaaaaauuagaugacugaa

SEQ ID NO: 39307 - RNA, 15 nt, Homo sapiens
aggaauuguuuuuau

SEQ ID NO: 39308 - RNA, 14 nt, Homo sapiens
uguacagucuugua

SEQ ID NO: 39309 - RNA, 13 nt, Homo sapiens
uguguuucuuuag

SEQ ID NO: 39310 - RNA, 18 nt, Homo sapiens
cauauugaugugugucua

SEQ ID NO: 39311 - RNA, 14 nt, Homo sapiens
auaugcaaagcacu

SEQ ID NO: 39312 - RNA, 22 nt, Homo sapiens
uguacaguuuuuauugcuuguu

SEQ ID NO: 39313 - RNA, 13 nt, Homo sapiens
cuuaguugcugua

SEQ ID NO: 39314 - RNA, 13 nt, Homo sapiens
ucuucacaacaga

SEQ ID NO: 39315 - RNA, 16 nt, Homo sapiens
aaguuuaauugacuua

SEQ ID NO: 39316 - RNA, 14 nt, Homo sapiens
cacaaaucuuaacu

SEQ ID NO: 39317 - RNA, 14 nt, Homo sapiens
agagaccacaagca

SEQ ID NO: 39318 - RNA, 19 nt, Homo sapiens
uacauuauuggacuuccau

SEQ ID NO: 39319 - RNA, 15 nt, Homo sapiens
auuauucccauucua

SEQ ID NO: 39320 - RNA, 17 nt, Homo sapiens
guacauguuaaacuuac

SEQ ID NO: 39321 - RNA, 18 nt, Homo sapiens
caagaugugggcagugau

SEQ ID NO: 39322 - RNA, 14 nt, Homo sapiens
ucaaauaugcaaag

SEQ ID NO: 39323 - RNA, 19 nt, Homo sapiens
aaguaugcacuaaucaaua

SEQ ID NO: 39324 - RNA, 18 nt, Homo sapiens
gccagacuggcacaguuu

SEQ ID NO: 39325 - RNA, 14 nt, Homo sapiens
agaugaugaugauc

SEQ ID NO: 39326 - RNA, 16 nt, Homo sapiens
aacuuacuuaguguua

SEQ ID NO: 39327 - RNA, 22 nt, Homo sapiens
gagaagagcuguucacagccag

SEQ ID NO: 39328 - RNA, 20 nt, Homo sapiens
cuaaucaauacuuugaacac

SEQ ID NO: 39329 - RNA, 13 nt, Homo sapiens
aguugcuguaugu

SEQ ID NO: 39330 - RNA, 19 nt, Homo sapiens
aauuucauaccuaucaucu

SEQ ID NO: 39331 - RNA, 15 nt, Homo sapiens
ccccucggagaagag

SEQ ID NO: 39332 - RNA, 16 nt, Homo sapiens
auaaaauucauuccau

SEQ ID NO: 39333 - RNA, 23 nt, Homo sapiens
gagcaguagcagcagcaucucug

SEQ ID NO: 39334 - RNA, 15 nt, Homo sapiens
aaaaucauuucugca

SEQ ID NO: 39335 - RNA, 15 nt, Homo sapiens
gcaccuacaguguac

SEQ ID NO: 39336 - RNA, 19 nt, Homo sapiens
gguuaccuuuguucccaaa

SEQ ID NO: 39337 - RNA, 22 nt, Homo sapiens
aagaugugggcagugaugucac

SEQ ID NO: 39338 - RNA, 19 nt, Homo sapiens
agacgugauuuugcuguag

SEQ ID NO: 39339 - RNA, 23 nt, Homo sapiens
gaaaugcugguuuuucaguuuuc

SEQ ID NO: 39340 - RNA, 19 nt, Homo sapiens
aagcaccuuuagaauauua

SEQ ID NO: 39341 - RNA, 16 nt, Homo sapiens
gcaaauuccaauacau

SEQ ID NO: 39342 - RNA, 20 nt, Homo sapiens
aagauggcacuuauaaccaa

SEQ ID NO: 39343 - RNA, 16 nt, Homo sapiens
accaauauuguacagu

SEQ ID NO: 39344 - RNA, 20 nt, Homo sapiens
ucaggaaaucaaauaugcaa

SEQ ID NO: 39345 - RNA, 17 nt, Homo sapiens
uggaaucauaugggaua

SEQ ID NO: 39346 - RNA, 14 nt, Homo sapiens
uugugaagaaacau

SEQ ID NO: 39347 - RNA, 17 nt, Homo sapiens
uacaaaaacacagcaag

SEQ ID NO: 39348 - RNA, 19 nt, Homo sapiens
guagaaaagggaacugaac

SEQ ID NO: 39349 - RNA, 14 nt, Homo sapiens
aacagucucaggaa

SEQ ID NO: 39350 - RNA, 20 nt, Homo sapiens
uugaaggaguccuugcauca

SEQ ID NO: 39351 - RNA, 13 nt, Homo sapiens
uaaguaaaaccac

SEQ ID NO: 39352 - RNA, 19 nt, Homo sapiens
augcacuaaucaauacuuu

SEQ ID NO: 39353 - RNA, 16 nt, Homo sapiens
auaaaauacauacuau

SEQ ID NO: 39354 - RNA, 23 nt, Homo sapiens
auuaaaacucauuuuuguuuuca

SEQ ID NO: 39355 - RNA, 21 nt, Homo sapiens
aggugcuacaaaaacacagca

SEQ ID NO: 39356 - RNA, 17 nt, Homo sapiens
gacgugauuuugcugua

SEQ ID NO: 39357 - RNA, 13 nt, Homo sapiens
caguguacagucu

SEQ ID NO: 39358 - RNA, 11 nt, Homo sapiens
aagacugacca

SEQ ID NO: 39359 - RNA, 19 nt, Homo sapiens
agggaacugaacauuccag

SEQ ID NO: 39360 - RNA, 19 nt, Homo sapiens
uuucauaccuaucaucuua

SEQ ID NO: 39361 - RNA, 15 nt, Homo sapiens
uucaguuuucaggag

SEQ ID NO: 39362 - RNA, 16 nt, Homo sapiens
aucacaaacucaucca

SEQ ID NO: 39363 - RNA, 20 nt, Homo sapiens
aauacauuauuggacuucca

SEQ ID NO: 39364 - RNA, 10 nt, Homo sapiens
ucauauugau

SEQ ID NO: 39365 - RNA, 12 nt, Homo sapiens
uauuuugaacaa

SEQ ID NO: 39366 - RNA, 16 nt, Homo sapiens
gauuuugcuguagaag

SEQ ID NO: 39367 - RNA, 17 nt, Homo sapiens
gguuaccuuuguuccca

SEQ ID NO: 39368 - RNA, 16 nt, Homo sapiens
caacagauuauuaccu

SEQ ID NO: 39369 - RNA, 20 nt, Homo sapiens
uuaaagcuuauuaaaacuca

SEQ ID NO: 39370 - RNA, 22 nt, Homo sapiens
guuuaugcauagauaaucucuc

SEQ ID NO: 39371 - RNA, 21 nt, Homo sapiens
gcaucaauuuuucuuauuuca

SEQ ID NO: 39372 - RNA, 16 nt, Homo sapiens
acuaauaaaauacaua

SEQ ID NO: 39373 - RNA, 20 nt, Homo sapiens
guucucuucuuuaaagggau

SEQ ID NO: 39374 - RNA, 14 nt, Homo sapiens
uucauuccauuugc

SEQ ID NO: 39375 - RNA, 12 nt, Homo sapiens
auacacacucaa

SEQ ID NO: 39376 - RNA, 15 nt, Homo sapiens
gugaacacaucagcu

SEQ ID NO: 39377 - RNA, 14 nt, Homo sapiens
acuuauuuauauaa

SEQ ID NO: 39378 - RNA, 20 nt, Homo sapiens
aggugcuacaaaaacacagc

SEQ ID NO: 39379 - RNA, 20 nt, Homo sapiens
ucuuauuucauuucuuugag

SEQ ID NO: 39380 - RNA, 20 nt, Homo sapiens
aauuauauuuugaacaacuc

SEQ ID NO: 39381 - RNA, 13 nt, Homo sapiens
accuacaguguac

SEQ ID NO: 39382 - RNA, 16 nt, Homo sapiens
acaacucgaaucacuc

SEQ ID NO: 39383 - RNA, 11 nt, Homo sapiens
ugaacauucca

SEQ ID NO: 39384 - RNA, 17 nt, Homo sapiens
agacuauucaaacaguc

SEQ ID NO: 39385 - RNA, 20 nt, Homo sapiens
uguuaauaaaaguacauguu

SEQ ID NO: 39386 - RNA, 13 nt, Homo sapiens
ucuuaagacguga

SEQ ID NO: 39387 - RNA, 20 nt, Homo sapiens
cuuuaaagggauggcaagau

SEQ ID NO: 39388 - RNA, 19 nt, Homo sapiens
agaugugggcagugauguc

SEQ ID NO: 39389 - RNA, 13 nt, Homo sapiens
ucuuaacuugaag

SEQ ID NO: 39390 - RNA, 20 nt, Homo sapiens
acagucucaggaaaucaaau

SEQ ID NO: 39391 - RNA, 19 nt, Homo sapiens
uucaaacagucucaggaaa

SEQ ID NO: 39392 - RNA, 14 nt, Homo sapiens
aaaauaccaugcca

SEQ ID NO: 39393 - RNA, 13 nt, Homo sapiens
auucccauucuac

SEQ ID NO: 39394 - RNA, 17 nt, Homo sapiens
uucccauucuacauacu

SEQ ID NO: 39395 - RNA, 20 nt, Homo sapiens
guuuaugcauagauaaucuc

SEQ ID NO: 39396 - RNA, 23 nt, Homo sapiens
cucauuuuuguuuucauuaucuc

SEQ ID NO: 39397 - RNA, 17 nt, Homo sapiens
acccucaagacaaauga

SEQ ID NO: 39398 - RNA, 16 nt, Homo sapiens
ugaaaagacuccaaag

SEQ ID NO: 39399 - RNA, 16 nt, Homo sapiens
uaauaaaaguacaugu

SEQ ID NO: 39400 - RNA, 15 nt, Homo sapiens
aaagaggcagcuuga

SEQ ID NO: 39401 - RNA, 18 nt, Homo sapiens
auuauuggacuuccauuu

SEQ ID NO: 39402 - RNA, 18 nt, Homo sapiens
agaauacuaauaaaauac

SEQ ID NO: 39403 - RNA, 18 nt, Homo sapiens
cucaacauaacauaagcu

SEQ ID NO: 39404 - RNA, 13 nt, Homo sapiens
agacuccaaagaa

SEQ ID NO: 39405 - RNA, 22 nt, Homo sapiens
acuucugucuucacaacagauu

SEQ ID NO: 39406 - RNA, 16 nt, Homo sapiens
uacagucuuguauuaa

SEQ ID NO: 39407 - RNA, 14 nt, Homo sapiens
aaaucauuucugca

SEQ ID NO: 39408 - RNA, 19 nt, Homo sapiens
augaugaucuuuaaaauac

SEQ ID NO: 39409 - RNA, 22 nt, Homo sapiens
ugauuucagcaccuacagugua

SEQ ID NO: 39410 - RNA, 22 nt, Homo sapiens
cauuaucucaaaacugcacugu

SEQ ID NO: 39411 - RNA, 15 nt, Homo sapiens
guauuaaguuguuaa

SEQ ID NO: 39412 - RNA, 22 nt, Homo sapiens
ucaggaaaucaaauaugcaaag

SEQ ID NO: 39413 - RNA, 16 nt, Homo sapiens
caaacagucucaggaa

SEQ ID NO: 39414 - RNA, 21 nt, Homo sapiens
gacaaaugacccccaucccau

SEQ ID NO: 39415 - RNA, 13 nt, Homo sapiens
accaauauuguac

SEQ ID NO: 39416 - RNA, 13 nt, Homo sapiens
auggaacauaaaa

SEQ ID NO: 39417 - RNA, 17 nt, Homo sapiens
acuaaucaauacuuuga

SEQ ID NO: 39418 - RNA, 16 nt, Homo sapiens
agucuuguauuaaguu

SEQ ID NO: 39419 - RNA, 19 nt, Homo sapiens
acuucuaaguaaaaccaca

SEQ ID NO: 39420 - RNA, 14 nt, Homo sapiens
aaaagacugaccaa

SEQ ID NO: 39421 - RNA, 14 nt, Homo sapiens
ugcuguaugucucg

SEQ ID NO: 39422 - RNA, 14 nt, Homo sapiens
ugggaaagcauugu

SEQ ID NO: 39423 - RNA, 22 nt, Homo sapiens
ucaaaauaccaugccauuuaaa

SEQ ID NO: 39424 - RNA, 17 nt, Homo sapiens
cauuauuggacuuccau

SEQ ID NO: 39425 - RNA, 20 nt, Homo sapiens
cggagaagagcuguucacag

SEQ ID NO: 39426 - RNA, 14 nt, Homo sapiens
gugaacacaucagc

SEQ ID NO: 39427 - RNA, 19 nt, Homo sapiens
ugaaggaguccuugcauca

SEQ ID NO: 39428 - RNA, 14 nt, Homo sapiens
augcaaagcacuga

SEQ ID NO: 39429 - RNA, 17 nt, Homo sapiens
gacuucugucuucacaa

SEQ ID NO: 39430 - RNA, 21 nt, Homo sapiens
acauacuauagauucuuuauu

SEQ ID NO: 39431 - RNA, 20 nt, Homo sapiens
uaaaaucacaaacucaucca

SEQ ID NO: 39432 - RNA, 18 nt, Homo sapiens
caaguccaagcauaccaa

SEQ ID NO: 39433 - RNA, 23 nt, Homo sapiens
acuuaagguuaccuuuguuccca

SEQ ID NO: 39434 - RNA, 19 nt, Homo sapiens
ccaaagcccaaagugguau

SEQ ID NO: 39435 - RNA, 14 nt, Homo sapiens
acugaacauuccag

SEQ ID NO: 39436 - RNA, 14 nt, Homo sapiens
cucgaaucacucau

SEQ ID NO: 39437 - RNA, 21 nt, Homo sapiens
ucccaaauuucauaccuauca

SEQ ID NO: 39438 - RNA, 23 nt, Homo sapiens
gcaucagcugcugaaacaacaaa

SEQ ID NO: 39439 - RNA, 16 nt, Homo sapiens
aaaaucacaaacucau

SEQ ID NO: 39440 - RNA, 23 nt, Homo sapiens
ccacagcaguugaaaagacucca

SEQ ID NO: 39441 - RNA, 17 nt, Homo sapiens
auaauaaaauucauucc

SEQ ID NO: 39442 - RNA, 13 nt, Homo sapiens
aaaagacugacca

SEQ ID NO: 39443 - RNA, 18 nt, Homo sapiens
uacauuauuggacuucca

SEQ ID NO: 39444 - RNA, 23 nt, Homo sapiens
auuaucucaaaacugcacuguca

SEQ ID NO: 39445 - RNA, 19 nt, Homo sapiens
ccaaagaaauguaagggaa

SEQ ID NO: 39446 - RNA, 15 nt, Homo sapiens
ucuacauacuaugga

SEQ ID NO: 39447 - RNA, 21 nt, Homo sapiens
ccaaguucuuaguugcuguau

SEQ ID NO: 39448 - RNA, 21 nt, Homo sapiens
gacucauuuuaaaaaauggaa

SEQ ID NO: 39449 - RNA, 15 nt, Homo sapiens
aaaagacuccaaaga

SEQ ID NO: 39450 - RNA, 20 nt, Homo sapiens
cccaaauuucauaccuauca

SEQ ID NO: 39451 - RNA, 20 nt, Homo sapiens
agaauauuaaaaauuaauuc

SEQ ID NO: 39452 - RNA, 23 nt, Homo sapiens
uucaaaaauuauauuuugaacaa

SEQ ID NO: 39453 - RNA, 19 nt, Homo sapiens
cucgugguaggacuguaga

SEQ ID NO: 39454 - RNA, 17 nt, Homo sapiens
ucuauggcauauugaua

SEQ ID NO: 39455 - RNA, 18 nt, Homo sapiens
agcauuguaaaugugcuu

SEQ ID NO: 39456 - RNA, 15 nt, Homo sapiens
aauucauuccauuug

SEQ ID NO: 39457 - RNA, 17 nt, Homo sapiens
uugaaaagacuccaaag

SEQ ID NO: 39458 - RNA, 18 nt, Homo sapiens
aucauuucugcaucagcu

SEQ ID NO: 39459 - RNA, 11 nt, Homo sapiens
uuugaacacaa

SEQ ID NO: 39460 - RNA, 21 nt, Homo sapiens
guuguuaauaaaaguacaugu

SEQ ID NO: 39461 - RNA, 16 nt, Homo sapiens
auuggacuuccauuug

SEQ ID NO: 39462 - RNA, 15 nt, Homo sapiens
ugugaacacaucagc

SEQ ID NO: 39463 - RNA, 18 nt, Homo sapiens
uuguuuucauuaucucaa

SEQ ID NO: 39464 - RNA, 17 nt, Homo sapiens
uaaaauacacacucaaa

SEQ ID NO: 39465 - RNA, 15 nt, Homo sapiens
aaagcacugacuucu

SEQ ID NO: 39466 - RNA, 16 nt, Homo sapiens
aaaugcugguuuuuca

SEQ ID NO: 39467 - RNA, 21 nt, Homo sapiens
aaugcugguuuuucaguuuuc

SEQ ID NO: 39468 - RNA, 16 nt, Homo sapiens
agcuuauuaaaacuca

SEQ ID NO: 39469 - RNA, 15 nt, Homo sapiens
ugaacacaucagcuu

SEQ ID NO: 39470 - RNA, 20 nt, Homo sapiens
aauuucauaccuaucaucuu

SEQ ID NO: 39471 - RNA, 18 nt, Homo sapiens
cuuuuaaaaaaaaauacu

SEQ ID NO: 39472 - RNA, 20 nt, Homo sapiens
gacgugauuuugcuguagaa

SEQ ID NO: 39473 - RNA, 20 nt, Homo sapiens
ucacaaacucauccauuaau

SEQ ID NO: 39474 - RNA, 17 nt, Homo sapiens
gaaaagggaacugaaca

SEQ ID NO: 39475 - RNA, 12 nt, Homo sapiens
ccacagcaguug

SEQ ID NO: 39476 - RNA, 15 nt, Homo sapiens
uguagauaaagcacu

SEQ ID NO: 39477 - RNA, 20 nt, Homo sapiens
agagaagauagcagggcaug

SEQ ID NO: 39478 - RNA, 22 nt, Homo sapiens
guuucauauugaugugugucua

SEQ ID NO: 39479 - RNA, 19 nt, Homo sapiens
gcaguugaaaagacuccaa

SEQ ID NO: 39480 - RNA, 21 nt, Homo sapiens
agcaaauuccaauacauuauu

SEQ ID NO: 39481 - RNA, 22 nt, Homo sapiens
auauuuguaucacaaaucuuaa

SEQ ID NO: 39482 - RNA, 20 nt, Homo sapiens
ccagguagagagaccacaag

SEQ ID NO: 39483 - RNA, 17 nt, Homo sapiens
caggauaagagggauua

SEQ ID NO: 39484 - RNA, 20 nt, Homo sapiens
uaaacuuacuuaguguuaug

SEQ ID NO: 39485 - RNA, 17 nt, Homo sapiens
ugcuacaaaaacacagc

SEQ ID NO: 39486 - RNA, 21 nt, Homo sapiens
caaguucuuaguugcuguaug

SEQ ID NO: 39487 - RNA, 16 nt, Homo sapiens
uguacagucuuguauu

SEQ ID NO: 39488 - RNA, 12 nt, Homo sapiens
uaugcacuaauc

SEQ ID NO: 39489 - RNA, 19 nt, Homo sapiens
gacgugauuuugcuguaga

SEQ ID NO: 39490 - RNA, 20 nt, Homo sapiens
auggaauuucucccagucau

SEQ ID NO: 39491 - RNA, 21 nt, Homo sapiens
gaccaauauuguacaguuuuu

SEQ ID NO: 39492 - RNA, 19 nt, Homo sapiens
caggugccaguuauggcua

SEQ ID NO: 39493 - RNA, 23 nt, Homo sapiens
gacuccaaagaaauguaagggaa

SEQ ID NO: 39494 - RNA, 17 nt, Homo sapiens
uagugaaucacguaaag

SEQ ID NO: 39495 - RNA, 23 nt, Homo sapiens
ucacaacagauuauuaccuuaca

SEQ ID NO: 39496 - RNA, 16 nt, Homo sapiens
agcaggcuacugucag

SEQ ID NO: 39497 - RNA, 13 nt, Homo sapiens
uccccucggagaa

SEQ ID NO: 39498 - RNA, 19 nt, Homo sapiens
cacucauuuauuuccauau

SEQ ID NO: 39499 - RNA, 14 nt, Homo sapiens
aaaauucauuccau

SEQ ID NO: 39500 - RNA, 18 nt, Homo sapiens
aacaacucgaaucacuca

SEQ ID NO: 39501 - RNA, 15 nt, Homo sapiens
cucaagacaaaugac

SEQ ID NO: 39502 - RNA, 15 nt, Homo sapiens
agcaaauuccaauac

SEQ ID NO: 39503 - RNA, 14 nt, Homo sapiens
auaccuaucaucuu

SEQ ID NO: 39504 - RNA, 21 nt, Homo sapiens
uccaaagaaauguaagggaaa

SEQ ID NO: 39505 - RNA, 19 nt, Homo sapiens
cgugguaggacuguagaaa

SEQ ID NO: 39506 - RNA, 20 nt, Homo sapiens
auacauuauuggacuuccau

SEQ ID NO: 39507 - RNA, 19 nt, Homo sapiens
aucacucauuuauuuccau

SEQ ID NO: 39508 - RNA, 13 nt, Homo sapiens
caagacaaaugac

SEQ ID NO: 39509 - RNA, 23 nt, Homo sapiens
ccaauacauuauuggacuuccau

SEQ ID NO: 39510 - RNA, 12 nt, Homo sapiens
uaauucuuuauc

SEQ ID NO: 39511 - RNA, 23 nt, Homo sapiens
guuguucucuucuuuaaagggau

SEQ ID NO: 39512 - RNA, 19 nt, Homo sapiens
agaugugaacacaucagcu

SEQ ID NO: 39513 - RNA, 20 nt, Homo sapiens
caaucacaaaaguauauuca

SEQ ID NO: 39514 - RNA, 19 nt, Homo sapiens
ucacaaaaguauauucaaa

SEQ ID NO: 39515 - RNA, 18 nt, Homo sapiens
gggacuucugucuucaca

SEQ ID NO: 39516 - RNA, 20 nt, Homo sapiens
accaauauuguacaguuuuu

SEQ ID NO: 39517 - RNA, 23 nt, Homo sapiens
aaacauuuaucuuuguacguucu

SEQ ID NO: 39518 - RNA, 18 nt, Homo sapiens
uaauaaaauucauuccau

SEQ ID NO: 39519 - RNA, 23 nt, Homo sapiens
gaauacuaauaaaauacauacua

SEQ ID NO: 39520 - RNA, 20 nt, Homo sapiens
caagcauaccaacacgagca

SEQ ID NO: 39521 - RNA, 17 nt, Homo sapiens
auguagauaaagcacug

SEQ ID NO: 39522 - RNA, 22 nt, Homo sapiens
cuagugaaagaggcagcuugaa

SEQ ID NO: 39523 - RNA, 16 nt, Homo sapiens
acuuacuuaguguuau

SEQ ID NO: 39524 - RNA, 14 nt, Homo sapiens
cuucacaacagauu

SEQ ID NO: 39525 - RNA, 20 nt, Homo sapiens
aaucaaauaugcaaagcacu

SEQ ID NO: 39526 - RNA, 20 nt, Homo sapiens
uuuuuauggaggcuuugcau

SEQ ID NO: 39527 - RNA, 21 nt, Homo sapiens
cagcaguugaaaagacuccaa

SEQ ID NO: 39528 - RNA, 12 nt, Homo sapiens
uaguugcuguau

SEQ ID NO: 39529 - RNA, 21 nt, Homo sapiens
uguuuaaaaucauuucugcau

SEQ ID NO: 39530 - RNA, 18 nt, Homo sapiens
aguaaaaccacagcaguu

SEQ ID NO: 39531 - RNA, 15 nt, Homo sapiens
cucccagucauuuaa

SEQ ID NO: 39532 - RNA, 19 nt, Homo sapiens
aguaugcacuaaucaauac

SEQ ID NO: 39533 - RNA, 22 nt, Homo sapiens
acuccaaagaaauguaagggaa

SEQ ID NO: 39534 - RNA, 15 nt, Homo sapiens
ugcugaaacaacaaa

SEQ ID NO: 39535 - RNA, 21 nt, Homo sapiens
guucucuucuuuaaagggaug

SEQ ID NO: 39536 - RNA, 21 nt, Homo sapiens
uuaaaaucacaaacucaucca

SEQ ID NO: 39537 - RNA, 16 nt, Homo sapiens
agucucaggaaaucaa

SEQ ID NO: 39538 - RNA, 22 nt, Homo sapiens
acacagcaagggugaugggaaa

SEQ ID NO: 39539 - RNA, 10 nt, Homo sapiens
aaagggaugg

SEQ ID NO: 39540 - RNA, 20 nt, Homo sapiens
gaaucacucauuuauuucca

SEQ ID NO: 39541 - RNA, 15 nt, Homo sapiens
uaccuaucaucuuaa

SEQ ID NO: 39542 - RNA, 13 nt, Homo sapiens
acaaacucaucca

SEQ ID NO: 39543 - RNA, 19 nt, Homo sapiens
acugagaugugaacacauc

SEQ ID NO: 39544 - RNA, 16 nt, Homo sapiens
acaguuuucugagaaa

SEQ ID NO: 39545 - RNA, 17 nt, Homo sapiens
aaugacccccaucccau

SEQ ID NO: 39546 - RNA, 15 nt, Homo sapiens
aaguaaaaccacagc

SEQ ID NO: 39547 - RNA, 19 nt, Homo sapiens
accuguggccaaguucuua

SEQ ID NO: 39548 - RNA, 15 nt, Homo sapiens
gauauaaaagacuga

SEQ ID NO: 39549 - RNA, 22 nt, Homo sapiens
cucaaaauaccaugccauuuaa

SEQ ID NO: 39550 - RNA, 21 nt, Homo sapiens
uauaggugcuacaaaaacaca

SEQ ID NO: 39551 - RNA, 14 nt, Homo sapiens
acauaacauaagcu

SEQ ID NO: 39552 - RNA, 22 nt, Homo sapiens
uuucugagaaagacuauucaaa

SEQ ID NO: 39553 - RNA, 16 nt, Homo sapiens
ucuaaguaaaaccaca

SEQ ID NO: 39554 - RNA, 19 nt, Homo sapiens
ucugagaaagacuauucaa

SEQ ID NO: 39555 - RNA, 15 nt, Homo sapiens
auauuaaaaucacaa

SEQ ID NO: 39556 - RNA, 18 nt, Homo sapiens
cauuuuaaaaaauggaac

SEQ ID NO: 39557 - RNA, 17 nt, Homo sapiens
caggcuacugucagcuc

SEQ ID NO: 39558 - RNA, 14 nt, Homo sapiens
aucauaugggauac

SEQ ID NO: 39559 - RNA, 14 nt, Homo sapiens
auucauuccauuug

SEQ ID NO: 39560 - RNA, 15 nt, Homo sapiens
uuuuccuguucuuaa

SEQ ID NO: 39561 - RNA, 20 nt, Homo sapiens
ugaacaacucgaaucacuca

SEQ ID NO: 39562 - RNA, 17 nt, Homo sapiens
ugaaaauauuuguauca

SEQ ID NO: 39563 - RNA, 15 nt, Homo sapiens
cagcaccuacagugu

SEQ ID NO: 39564 - RNA, 18 nt, Homo sapiens
gaaagacuauucaaacag

SEQ ID NO: 39565 - RNA, 11 nt, Homo sapiens
uuaaaaucaca

SEQ ID NO: 39566 - RNA, 19 nt, Homo sapiens
auacauuauuggacuucca

SEQ ID NO: 39567 - RNA, 22 nt, Homo sapiens
aacuuccuuggacucauuuuaa

SEQ ID NO: 39568 - RNA, 18 nt, Homo sapiens
ccagagcguguagugaau

SEQ ID NO: 39569 - RNA, 16 nt, Homo sapiens
cgugauuuugcuguag

SEQ ID NO: 39570 - RNA, 20 nt, Homo sapiens
auaggugcuacaaaaacaca

SEQ ID NO: 39571 - RNA, 23 nt, Homo sapiens
ucucaggaaaucaaauaugcaaa

SEQ ID NO: 39572 - RNA, 17 nt, Homo sapiens
cucauuuuuguuuucau

SEQ ID NO: 39573 - RNA, 16 nt, Homo sapiens
aaucauuucugcauca

SEQ ID NO: 39574 - RNA, 22 nt, Homo sapiens
agaugugggcagugaugucacu

SEQ ID NO: 39575 - RNA, 21 nt, Homo sapiens
acuuccuuggacucauuuuaa

SEQ ID NO: 39576 - RNA, 12 nt, Homo sapiens
ucgaaucacuca

SEQ ID NO: 39577 - RNA, 23 nt, Homo sapiens
ucuuaagacgugauuuugcugua

SEQ ID NO: 39578 - RNA, 17 nt, Homo sapiens
aauacacacucaaauca

SEQ ID NO: 39579 - RNA, 16 nt, Homo sapiens
cucaaaacugcacugu

SEQ ID NO: 39580 - RNA, 18 nt, Homo sapiens
aucacucauuuauuucca

SEQ ID NO: 39581 - RNA, 15 nt, Homo sapiens
ugaacacaaagccug

SEQ ID NO: 39582 - RNA, 23 nt, Homo sapiens
gucucgugguaggacuguagaaa

SEQ ID NO: 39583 - RNA, 18 nt, Homo sapiens
ugcuacaaaaacacagca

SEQ ID NO: 39584 - RNA, 19 nt, Homo sapiens
ugugaacacaucagcuugc

SEQ ID NO: 39585 - RNA, 22 nt, Homo sapiens
acuggcacaguuuucugagaaa

SEQ ID NO: 39586 - RNA, 21 nt, Homo sapiens
caaauaugcaaagcacugacu

SEQ ID NO: 39587 - RNA, 14 nt, Homo sapiens
uccaagcauaccaa

SEQ ID NO: 39588 - RNA, 13 nt, Homo sapiens
cuacaaaaacaca

SEQ ID NO: 39589 - RNA, 15 nt, Homo sapiens
aacugaacauuccag

SEQ ID NO: 39590 - RNA, 18 nt, Homo sapiens
uagcaaauuccaauacau

SEQ ID NO: 39591 - RNA, 23 nt, Homo sapiens
cacugacuucuaaguaaaaccac

SEQ ID NO: 39592 - RNA, 19 nt, Homo sapiens
aaacugcacugucaagaug

SEQ ID NO: 39593 - RNA, 14 nt, Homo sapiens
uaaguaaaaccaca

SEQ ID NO: 39594 - RNA, 14 nt, Homo sapiens
uuuauugcuuguug

SEQ ID NO: 39595 - RNA, 18 nt, Homo sapiens
ugagaaagacuauucaaa

SEQ ID NO: 39596 - RNA, 22 nt, Homo sapiens
cuccaaagaaauguaagggaaa

SEQ ID NO: 39597 - RNA, 13 nt, Homo sapiens
gucuuguguuucu

SEQ ID NO: 39598 - RNA, 14 nt, Homo sapiens
auucuuuaucacau

SEQ ID NO: 39599 - RNA, 23 nt, Homo sapiens
ucacaaaucuuaacuugaaggag

SEQ ID NO: 39600 - RNA, 21 nt, Homo sapiens
cugaccaauauuguacaguuu

SEQ ID NO: 39601 - RNA, 21 nt, Homo sapiens
uuuaaaaucauuucugcauca

SEQ ID NO: 39602 - RNA, 21 nt, Homo sapiens
auuuaauaaaugugccuucau

SEQ ID NO: 39603 - RNA, 23 nt, Homo sapiens
aaaugcugguuuuucaguuuuca

SEQ ID NO: 39604 - RNA, 11 nt, Homo sapiens
aauacugaugu

SEQ ID NO: 39605 - RNA, 23 nt, Homo sapiens
augugcuuuuaaaaaaaaauacu

SEQ ID NO: 39606 - RNA, 14 nt, Homo sapiens
ugaagaaacauuua

SEQ ID NO: 39607 - RNA, 22 nt, Homo sapiens
acaagcaggcucaacauaacau

SEQ ID NO: 39608 - RNA, 12 nt, Homo sapiens
aacugccagcaa

SEQ ID NO: 39609 - RNA, 13 nt, Homo sapiens
uauuggacuucca

SEQ ID NO: 39610 - RNA, 19 nt, Homo sapiens
uucacagccagacuggcac

SEQ ID NO: 39611 - RNA, 20 nt, Homo sapiens
gaacguuuuuccuguucuua

SEQ ID NO: 39612 - RNA, 19 nt, Homo sapiens
agauaaucucuccauuccc

SEQ ID NO: 39613 - RNA, 16 nt, Homo sapiens
auaauaaaauucauuc

SEQ ID NO: 39614 - RNA, 17 nt, Homo sapiens
caaaacugcacugucaa

SEQ ID NO: 39615 - RNA, 21 nt, Homo sapiens
cauucccguggaacguuuuuc

SEQ ID NO: 39616 - RNA, 15 nt, Homo sapiens
uaaaauacacacuca

SEQ ID NO: 39617 - RNA, 18 nt, Homo sapiens
caaaucuuaacuugaagg

SEQ ID NO: 39618 - RNA, 17 nt, Homo sapiens
aagaugaugaugaucuu

SEQ ID NO: 39619 - RNA, 22 nt, Homo sapiens
aggaaaucaaauaugcaaagca

SEQ ID NO: 39620 - RNA, 18 nt, Homo sapiens
agcauaccaacacgagca

SEQ ID NO: 39621 - RNA, 21 nt, Homo sapiens
ucucaaaacugcacugucaag

SEQ ID NO: 39622 - RNA, 21 nt, Homo sapiens
auuucauaccuaucaucuuaa

SEQ ID NO: 39623 - RNA, 16 nt, Homo sapiens
uacauacuauggaauu

SEQ ID NO: 39624 - RNA, 21 nt, Homo sapiens
ucuuauccugucccuccucca

SEQ ID NO: 39625 - RNA, 17 nt, Homo sapiens
cgagcaggcuacuguca

SEQ ID NO: 39626 - RNA, 23 nt, Homo sapiens
ugucucgugguaggacuguagaa

SEQ ID NO: 39627 - RNA, 20 nt, Homo sapiens
uuugaacaacucgaaucacu

SEQ ID NO: 39628 - RNA, 14 nt, Homo sapiens
aaauuuaaauggag

SEQ ID NO: 39629 - RNA, 13 nt, Homo sapiens
acagucucaggaa

SEQ ID NO: 39630 - RNA, 16 nt, Homo sapiens
uuggacuuccauuugg

SEQ ID NO: 39631 - RNA, 16 nt, Homo sapiens
aauuucauaccuauca

SEQ ID NO: 39632 - RNA, 20 nt, Homo sapiens
acacgagcaggcuacuguca

SEQ ID NO: 39633 - RNA, 21 nt, Homo sapiens
uauggcuauaggugcuacaaa

SEQ ID NO: 39634 - RNA, 17 nt, Homo sapiens
ucaaaacugcacuguca

SEQ ID NO: 39635 - RNA, 21 nt, Homo sapiens
aauuucauaccuaucaucuua

SEQ ID NO: 39636 - RNA, 18 nt, Homo sapiens
gacaggauaagagggauu

SEQ ID NO: 39637 - RNA, 20 nt, Homo sapiens
uuaaaaaaaaauacugaugu

SEQ ID NO: 39638 - RNA, 15 nt, Homo sapiens
ucuagaauacuaaua

SEQ ID NO: 39639 - RNA, 15 nt, Homo sapiens
cuguggccaaguucu

SEQ ID NO: 39640 - RNA, 20 nt, Homo sapiens
acagccagacuggcacaguu

SEQ ID NO: 39641 - RNA, 18 nt, Homo sapiens
aaaaccacagcaguugaa

SEQ ID NO: 39642 - RNA, 18 nt, Homo sapiens
aaguacauguuaaacuua

SEQ ID NO: 39643 - RNA, 22 nt, Homo sapiens
cuuuaguuuuugugaaguuuaa

SEQ ID NO: 39644 - RNA, 19 nt, Homo sapiens
auaggugcuacaaaaacac

SEQ ID NO: 39645 - RNA, 19 nt, Homo sapiens
ucaagaugaugaugaucuu

SEQ ID NO: 39646 - RNA, 13 nt, Homo sapiens
aaguaaaaccaca

SEQ ID NO: 39647 - RNA, 20 nt, Homo sapiens
agcaaauuccaauacauuau

SEQ ID NO: 39648 - RNA, 18 nt, Homo sapiens
ugaaagaggcagcuugaa

SEQ ID NO: 39649 - RNA, 19 nt, Homo sapiens
cgugauuuugcuguagaag

SEQ ID NO: 39650 - RNA, 16 nt, Homo sapiens
uauaaaagacugacca

SEQ ID NO: 39651 - RNA, 20 nt, Homo sapiens
ugcaaccccaucauccucag

SEQ ID NO: 39652 - RNA, 23 nt, Homo sapiens
gcuguucacagccagacuggcac

SEQ ID NO: 39653 - RNA, 12 nt, Homo sapiens
uuugcuguagaa

SEQ ID NO: 39654 - RNA, 18 nt, Homo sapiens
gauaaucucuccauuccc

SEQ ID NO: 39655 - RNA, 21 nt, Homo sapiens
agauguagcaaauuccaauac

SEQ ID NO: 39656 - RNA, 18 nt, Homo sapiens
ucuucacaacagauuauu

SEQ ID NO: 39657 - RNA, 15 nt, Homo sapiens
gagaaagacuauuca

SEQ ID NO: 39658 - RNA, 16 nt, Homo sapiens
aagaugaugaugaucu

SEQ ID NO: 39659 - RNA, 16 nt, Homo sapiens
acacacucaaaucaag

SEQ ID NO: 39660 - RNA, 19 nt, Homo sapiens
ucgugguaggacuguagaa

SEQ ID NO: 39661 - RNA, 13 nt, Homo sapiens
cagcuguuuaugc

SEQ ID NO: 39662 - RNA, 18 nt, Homo sapiens
ugugaaguuuaauugacu

SEQ ID NO: 39663 - RNA, 16 nt, Homo sapiens
uauagaaaugcugguu

SEQ ID NO: 39664 - RNA, 16 nt, Homo sapiens
auggcuauaggugcua

SEQ ID NO: 39665 - RNA, 17 nt, Homo sapiens
gagcaggcuacugucag

SEQ ID NO: 39666 - RNA, 21 nt, Homo sapiens
aucuuuaaaauacacacucaa

SEQ ID NO: 39667 - RNA, 11 nt, Homo sapiens
guauauucaaa

SEQ ID NO: 39668 - RNA, 21 nt, Homo sapiens
acuucugucuucacaacagau

SEQ ID NO: 39669 - RNA, 13 nt, Homo sapiens
gcagugaugucac

SEQ ID NO: 39670 - RNA, 22 nt, Homo sapiens
caacacgagcaggcuacuguca

SEQ ID NO: 39671 - RNA, 18 nt, Homo sapiens
gcaggcccccaggugcca

SEQ ID NO: 39672 - RNA, 18 nt, Homo sapiens
aaguucuuaguugcugua

SEQ ID NO: 39673 - RNA, 14 nt, Homo sapiens
aucacucauuuauu

SEQ ID NO: 39674 - RNA, 19 nt, Homo sapiens
aguuauggcuauaggugcu

SEQ ID NO: 39675 - RNA, 23 nt, Homo sapiens
uauugauaauaaaauucauucca

SEQ ID NO: 39676 - RNA, 22 nt, Homo sapiens
aaacugagaugugaacacauca

SEQ ID NO: 39677 - RNA, 21 nt, Homo sapiens
aaacugagaugugaacacauc

SEQ ID NO: 39678 - RNA, 11 nt, Homo sapiens
ucauuaucuca

SEQ ID NO: 39679 - RNA, 16 nt, Homo sapiens
gaaguuuaauugacuu

SEQ ID NO: 39680 - RNA, 20 nt, Homo sapiens
caucagcuugcccuguuaaa

SEQ ID NO: 39681 - RNA, 22 nt, Homo sapiens
uccaagcauaccaacacgagca

SEQ ID NO: 39682 - RNA, 18 nt, Homo sapiens
auuuuucagauauaaaag

SEQ ID NO: 39683 - RNA, 13 nt, Homo sapiens
ggacuuccauuug

SEQ ID NO: 39684 - RNA, 20 nt, Homo sapiens
caaaaauuauauuuugaaca

SEQ ID NO: 39685 - RNA, 18 nt, Homo sapiens
auaaaauucauuccauuu

SEQ ID NO: 39686 - RNA, 18 nt, Homo sapiens
uucccaaauuucauaccu

SEQ ID NO: 39687 - RNA, 21 nt, Homo sapiens
ugcuguagaagauggcacuua

SEQ ID NO: 39688 - RNA, 16 nt, Homo sapiens
caaaucuuaacuugaa

SEQ ID NO: 39689 - RNA, 22 nt, Homo sapiens
aaaauauuuguaucacaaaucu

SEQ ID NO: 39690 - RNA, 15 nt, Homo sapiens
cacaaacucauccau

SEQ ID NO: 39691 - RNA, 15 nt, Homo sapiens
acuucugucuucaca

SEQ ID NO: 39692 - RNA, 14 nt, Homo sapiens
uuaaacuuacuuag

SEQ ID NO: 39693 - RNA, 18 nt, Homo sapiens
ucucgugguaggacugua

SEQ ID NO: 39694 - RNA, 23 nt, Homo sapiens
ucagauauaaaagacugaccaau

SEQ ID NO: 39695 - RNA, 19 nt, Homo sapiens
uggcacaguuuucugagaa

SEQ ID NO: 39696 - RNA, 22 nt, Homo sapiens
aauacugauguuccuagugaaa

SEQ ID NO: 39697 - RNA, 20 nt, Homo sapiens
aagacuauucaaacagucuc

SEQ ID NO: 39698 - RNA, 18 nt, Homo sapiens
gacgugauuuugcuguag

SEQ ID NO: 39699 - RNA, 18 nt, Homo sapiens
accauaaauuuaaaugga

SEQ ID NO: 39700 - RNA, 15 nt, Homo sapiens
ugcaucagcugcuga

SEQ ID NO: 39701 - RNA, 15 nt, Homo sapiens
gaaucauaugggaua

SEQ ID NO: 39702 - RNA, 19 nt, Homo sapiens
ucuaaguaaaaccacagca

SEQ ID NO: 39703 - RNA, 22 nt, Homo sapiens
agaagauggcacuuauaaccaa

SEQ ID NO: 39704 - RNA, 15 nt, Homo sapiens
gcaggcuacugucag

SEQ ID NO: 39705 - RNA, 19 nt, Homo sapiens
uucuacauacuauggaauu

SEQ ID NO: 39706 - RNA, 17 nt, Homo sapiens
agcauuguaaaugugcu

SEQ ID NO: 39707 - RNA, 19 nt, Homo sapiens
guguacagucuuguauuaa

SEQ ID NO: 39708 - RNA, 15 nt, Homo sapiens
uugaaacugagaugu

SEQ ID NO: 39709 - RNA, 15 nt, Homo sapiens
gaacugaacauucca

SEQ ID NO: 39710 - RNA, 20 nt, Homo sapiens
ucauuuuaaaaaauggaaca

SEQ ID NO: 39711 - RNA, 16 nt, Homo sapiens
gagcaggcuacuguca

SEQ ID NO: 39712 - RNA, 17 nt, Homo sapiens
cacauuuuucagauaua

SEQ ID NO: 39713 - RNA, 20 nt, Homo sapiens
gacuucugucuucacaacag

SEQ ID NO: 39714 - RNA, 9 nt, Homo sapiens
agagaagau

SEQ ID NO: 39715 - RNA, 12 nt, Homo sapiens
cauuccauuugc

SEQ ID NO: 39716 - RNA, 15 nt, Homo sapiens
auuucugcaucagcu

SEQ ID NO: 39717 - RNA, 21 nt, Homo sapiens
ugucuuaauuaaaagaauauu

SEQ ID NO: 39718 - RNA, 21 nt, Homo sapiens
ccauucuacauacuauggaau

SEQ ID NO: 39719 - RNA, 15 nt, Homo sapiens
guugcuguaugucuc

SEQ ID NO: 39720 - RNA, 19 nt, Homo sapiens
uaaguuacacauuuuucag

SEQ ID NO: 39721 - RNA, 22 nt, Homo sapiens
cggagaagagcuguucacagcc

SEQ ID NO: 39722 - RNA, 14 nt, Homo sapiens
uagaagauggcacu

SEQ ID NO: 39723 - RNA, 16 nt, Homo sapiens
aaucucuccauucccg

SEQ ID NO: 39724 - RNA, 15 nt, Homo sapiens
aaaucuuaacuugaa

SEQ ID NO: 39725 - RNA, 14 nt, Homo sapiens
aacugcacugucaa

SEQ ID NO: 39726 - RNA, 20 nt, Homo sapiens
cucgugguaggacuguagaa

SEQ ID NO: 39727 - RNA, 15 nt, Homo sapiens
uacaaaaacacagca

SEQ ID NO: 39728 - RNA, 16 nt, Homo sapiens
uaauucuuuaucacau

SEQ ID NO: 39729 - RNA, 17 nt, Homo sapiens
cuauucaaacagucuca

SEQ ID NO: 39730 - RNA, 16 nt, Homo sapiens
aaacauuuaucuuugu

SEQ ID NO: 39731 - RNA, 22 nt, Homo sapiens
cuuaagacgugauuuugcugua

SEQ ID NO: 39732 - RNA, 20 nt, Homo sapiens
ucauuaucucaaaacugcac

SEQ ID NO: 39733 - RNA, 21 nt, Homo sapiens
uuuaaaaaaaaauacugaugu

SEQ ID NO: 39734 - RNA, 17 nt, Homo sapiens
auacauacuauagauuc

SEQ ID NO: 39735 - RNA, 22 nt, Homo sapiens
ucagcaccuacaguguacaguc

SEQ ID NO: 39736 - RNA, 21 nt, Homo sapiens
cacagcaagggugaugggaaa

SEQ ID NO: 39737 - RNA, 15 nt, Homo sapiens
gccaguuauggcuau

SEQ ID NO: 39738 - RNA, 16 nt, Homo sapiens
cuugaaacugagaugu

SEQ ID NO: 39739 - RNA, 15 nt, Homo sapiens
aguuguuaauaaaag

SEQ ID NO: 39740 - RNA, 19 nt, Homo sapiens
aaucacucauuuauuucca

SEQ ID NO: 39741 - RNA, 16 nt, Homo sapiens
ucagcaccuacagugu

SEQ ID NO: 39742 - RNA, 20 nt, Homo sapiens
auaaagcacuguuuggauau

SEQ ID NO: 39743 - RNA, 18 nt, Homo sapiens
ggacaggauaagagggau

SEQ ID NO: 39744 - RNA, 18 nt, Homo sapiens
acaucagcuugcccuguu

SEQ ID NO: 39745 - RNA, 22 nt, Homo sapiens
acgagcaggcuacugucagcuc

SEQ ID NO: 39746 - RNA, 16 nt, Homo sapiens
uagaaaagggaacuga

SEQ ID NO: 39747 - RNA, 22 nt, Homo sapiens
cuguagaaaagggaacugaaca

SEQ ID NO: 39748 - RNA, 19 nt, Homo sapiens
uaaaaucauuucugcauca

SEQ ID NO: 39749 - RNA, 20 nt, Homo sapiens
aucaaauaugcaaagcacug

SEQ ID NO: 39750 - RNA, 17 nt, Homo sapiens
aaggaguccuugcauca

SEQ ID NO: 39751 - RNA, 19 nt, Homo sapiens
ccaaauuucauaccuauca

SEQ ID NO: 39752 - RNA, 23 nt, Homo sapiens
ugaaacugagaugugaacacauc

SEQ ID NO: 39753 - RNA, 20 nt, Homo sapiens
acuucuaaguaaaaccacag

SEQ ID NO: 39754 - RNA, 16 nt, Homo sapiens
auguagauaaagcacu

SEQ ID NO: 39755 - RNA, 16 nt, Homo sapiens
ucuacauacuauggaa

SEQ ID NO: 39756 - RNA, 16 nt, Homo sapiens
ucauaccuaucaucuu

SEQ ID NO: 39757 - RNA, 19 nt, Homo sapiens
uagugaaguaugcacuaau

SEQ ID NO: 39758 - RNA, 14 nt, Homo sapiens
aaagacuccaaaga

SEQ ID NO: 39759 - RNA, 18 nt, Homo sapiens
uaauguagauaaagcacu

SEQ ID NO: 39760 - RNA, 16 nt, Homo sapiens
uacaaaaacacagcaa

SEQ ID NO: 39761 - RNA, 14 nt, Homo sapiens
gcuguagaagaugg

SEQ ID NO: 39762 - RNA, 16 nt, Homo sapiens
uaagggaaacugccag

SEQ ID NO: 39763 - RNA, 18 nt, Homo sapiens
cacaaacucauccauuaa

SEQ ID NO: 39764 - RNA, 19 nt, Homo sapiens
aacaacucgaaucacucau

SEQ ID NO: 39765 - RNA, 13 nt, Homo sapiens
aauuccaauacau

SEQ ID NO: 39766 - RNA, 15 nt, Homo sapiens
uggacuuccauuugg

SEQ ID NO: 39767 - RNA, 14 nt, Homo sapiens
ugaacacaucagcu

SEQ ID NO: 39768 - RNA, 14 nt, Homo sapiens
cuagaauacuaaua

SEQ ID NO: 39769 - RNA, 16 nt, Homo sapiens
caggcucaacauaaca

SEQ ID NO: 39770 - RNA, 14 nt, Homo sapiens
guuuucauuaucuc

SEQ ID NO: 39771 - RNA, 13 nt, Homo sapiens
uguaaaugugcuu

SEQ ID NO: 39772 - RNA, 18 nt, Homo sapiens
cuuuuuuuuaaguuacac

SEQ ID NO: 39773 - RNA, 22 nt, Homo sapiens
caauacauuauuggacuuccau

SEQ ID NO: 39774 - RNA, 20 nt, Homo sapiens
gagcaggcuacugucagcuc

SEQ ID NO: 39775 - RNA, 13 nt, Homo sapiens
uuuaaaaaaugga

SEQ ID NO: 39776 - RNA, 22 nt, Homo sapiens
acuucuaaguaaaaccacagca

SEQ ID NO: 39777 - RNA, 17 nt, Homo sapiens
gcauuguaaaugugcuu

SEQ ID NO: 39778 - RNA, 23 nt, Homo sapiens
ucaacaagagacuggaaggacca

SEQ ID NO: 39779 - RNA, 20 nt, Homo sapiens
uagauaaucucuccauuccc

SEQ ID NO: 39780 - RNA, 17 nt, Homo sapiens
gugccaguuauggcuau

SEQ ID NO: 39781 - RNA, 21 nt, Homo sapiens
uaaaaucacaaacucauccau

SEQ ID NO: 39782 - RNA, 11 nt, Homo sapiens
aagcauuguaa

SEQ ID NO: 39783 - RNA, 20 nt, Homo sapiens
uguucacagccagacuggca

SEQ ID NO: 39784 - RNA, 19 nt, Homo sapiens
cucauuuauuuccauauua

SEQ ID NO: 39785 - RNA, 16 nt, Homo sapiens
ucacaaacucauccau

SEQ ID NO: 39786 - RNA, 21 nt, Homo sapiens
aacacgagcaggcuacuguca

SEQ ID NO: 39787 - RNA, 15 nt, Homo sapiens
acucauuuauuucca

SEQ ID NO: 39788 - RNA, 14 nt, Homo sapiens
uuaauaaaaguaca

SEQ ID NO: 39789 - RNA, 13 nt, Homo sapiens
acaaaaacacagc

SEQ ID NO: 39790 - RNA, 18 nt, Homo sapiens
aaguagggacuucugucu

SEQ ID NO: 39791 - RNA, 21 nt, Homo sapiens
ucaaauaugcaaagcacugac

SEQ ID NO: 39792 - RNA, 22 nt, Homo sapiens
uagugaaucacguaaagcuaga

SEQ ID NO: 39793 - RNA, 16 nt, Homo sapiens
cacucauuuauuucca

SEQ ID NO: 39794 - RNA, 13 nt, Homo sapiens
uagauucuuuauu

SEQ ID NO: 39795 - RNA, 18 nt, Homo sapiens
cucaaaauaccaugccau

SEQ ID NO: 39796 - RNA, 23 nt, Homo sapiens
uucagauauaaaagacugaccaa

SEQ ID NO: 39797 - RNA, 17 nt, Homo sapiens
acauuauuggacuucca

SEQ ID NO: 39798 - RNA, 14 nt, Homo sapiens
aaauacauacuaua

SEQ ID NO: 39799 - RNA, 13 nt, Homo sapiens
aauguuguucucu

SEQ ID NO: 39800 - RNA, 17 nt, Homo sapiens
uucugagaaagacuauu

SEQ ID NO: 39801 - RNA, 19 nt, Homo sapiens
auaauaaaauucauuccau

SEQ ID NO: 39802 - RNA, 18 nt, Homo sapiens
uacuauagauucuuuauu

SEQ ID NO: 39803 - RNA, 19 nt, Homo sapiens
uauuagugaaguaugcacu

SEQ ID NO: 39804 - RNA, 16 nt, Homo sapiens
gcuacaaaaacacagc

SEQ ID NO: 39805 - RNA, 14 nt, Homo sapiens
agccagacuggcac

SEQ ID NO: 39806 - RNA, 18 nt, Homo sapiens
aaguccaagcauaccaac

SEQ ID NO: 39807 - RNA, 15 nt, Homo sapiens
gugaaagaggcagcu

SEQ ID NO: 39808 - RNA, 12 nt, Homo sapiens
aaaaagccaaaa

SEQ ID NO: 39809 - RNA, 13 nt, Homo sapiens
aaaaagcuacuua

SEQ ID NO: 39810 - RNA, 13 nt, Homo sapiens
aaaaaggugacca

SEQ ID NO: 39811 - RNA, 17 nt, Homo sapiens
aaaaauaaagcacuuau

SEQ ID NO: 39812 - RNA, 21 nt, Homo sapiens
aaaaaugguuuaaauggucaa

SEQ ID NO: 39813 - RNA, 19 nt, Homo sapiens
aaaacaccaggauuuaagu

SEQ ID NO: 39814 - RNA, 14 nt, Homo sapiens
aaaacguauugcau

SEQ ID NO: 39815 - RNA, 19 nt, Homo sapiens
aaaacguauugcauuuaau

SEQ ID NO: 39816 - RNA, 22 nt, Homo sapiens
aaaacuuauccuccaugaauau

SEQ ID NO: 39817 - RNA, 15 nt, Homo sapiens
aaaagaaacauuugg

SEQ ID NO: 39818 - RNA, 12 nt, Homo sapiens
aaaagaaagaaa

SEQ ID NO: 39819 - RNA, 11 nt, Homo sapiens
aaaagcacuua

SEQ ID NO: 39820 - RNA, 18 nt, Homo sapiens
aaaagcaguaacugacaa

SEQ ID NO: 39821 - RNA, 11 nt, Homo sapiens
aaaagccaaaa

SEQ ID NO: 39822 - RNA, 16 nt, Homo sapiens
aaaagccaaaaaccaa

SEQ ID NO: 39823 - RNA, 21 nt, Homo sapiens
aaaagcuacuuauuguagcau

SEQ ID NO: 39824 - RNA, 12 nt, Homo sapiens
aaaaggaagaaa

SEQ ID NO: 39825 - RNA, 23 nt, Homo sapiens
aaaaggccugucccugcagacau

SEQ ID NO: 39826 - RNA, 16 nt, Homo sapiens
aaaagggaacugaaca

SEQ ID NO: 39827 - RNA, 16 nt, Homo sapiens
aaaaguugaauuuuac

SEQ ID NO: 39828 - RNA, 12 nt, Homo sapiens
aaaauacauacu

SEQ ID NO: 39829 - RNA, 16 nt, Homo sapiens
aaaauaccagccagua

SEQ ID NO: 39830 - RNA, 10 nt, Homo sapiens
aaaauaugcc

SEQ ID NO: 39831 - RNA, 19 nt, Homo sapiens
aaaauauuuuuaugugcaa

SEQ ID NO: 39832 - RNA, 22 nt, Homo sapiens
aaaauauuuuuaugugcaauaa

SEQ ID NO: 39833 - RNA, 16 nt, Homo sapiens
aaaaucacaaacucau

SEQ ID NO: 39834 - RNA, 15 nt, Homo sapiens
aaaaucauuucugca

SEQ ID NO: 39835 - RNA, 20 nt, Homo sapiens
aaaaucauuucugcaucagc

SEQ ID NO: 39836 - RNA, 14 nt, Homo sapiens
aaaaugagcaaaag

SEQ ID NO: 39837 - RNA, 14 nt, Homo sapiens
aaaauggaauacuc

SEQ ID NO: 39838 - RNA, 16 nt, Homo sapiens
aaaauggccagugaga

SEQ ID NO: 39839 - RNA, 12 nt, Homo sapiens
aaaaugugcaau

SEQ ID NO: 39840 - RNA, 17 nt, Homo sapiens
aaaauguucuaaauauc

SEQ ID NO: 39841 - RNA, 14 nt, Homo sapiens
aaaauucauuccau

SEQ ID NO: 39842 - RNA, 20 nt, Homo sapiens
aaaauucauuccauuugcug

SEQ ID NO: 39843 - RNA, 11 nt, Homo sapiens
aaacacauuuu

SEQ ID NO: 39844 - RNA, 16 nt, Homo sapiens
aaacaccucagcugcc

SEQ ID NO: 39845 - RNA, 20 nt, Homo sapiens
aaacacuaaaaaggcaugua

SEQ ID NO: 39846 - RNA, 14 nt, Homo sapiens
aaacauagcaucuc

SEQ ID NO: 39847 - RNA, 17 nt, Homo sapiens
aaacauagcaucucagg

SEQ ID NO: 39848 - RNA, 16 nt, Homo sapiens
aaacauccagauacac

SEQ ID NO: 39849 - RNA, 14 nt, Homo sapiens
aaacauguauguaa

SEQ ID NO: 39850 - RNA, 22 nt, Homo sapiens
aaacauguauguaaauagcuaa

SEQ ID NO: 39851 - RNA, 15 nt, Homo sapiens
aaacauguucacuua

SEQ ID NO: 39852 - RNA, 23 nt, Homo sapiens
aaacauuuaaauuauacaaucau

SEQ ID NO: 39853 - RNA, 16 nt, Homo sapiens
aaacauuuaucuuugu

SEQ ID NO: 39854 - RNA, 23 nt, Homo sapiens
aaacauuuaucuuuguacguucu

SEQ ID NO: 39855 - RNA, 14 nt, Homo sapiens
aaacauuugguaag

SEQ ID NO: 39856 - RNA, 13 nt, Homo sapiens
aaacccggccuga

SEQ ID NO: 39857 - RNA, 17 nt, Homo sapiens
aaacccggccugauuaa

SEQ ID NO: 39858 - RNA, 12 nt, Homo sapiens
aaaccuaugaau

SEQ ID NO: 39859 - RNA, 14 nt, Homo sapiens
aaaccucaagccag

SEQ ID NO: 39860 - RNA, 16 nt, Homo sapiens
aaacguauugcauuua

SEQ ID NO: 39861 - RNA, 17 nt, Homo sapiens
aaacgucuuaaauauuc

SEQ ID NO: 39862 - RNA, 15 nt, Homo sapiens
aaacgugauuuuuaa

SEQ ID NO: 39863 - RNA, 21 nt, Homo sapiens
aaacuaccagcccuacaccau

SEQ ID NO: 39864 - RNA, 16 nt, Homo sapiens
aaacuaguuacuaaac

SEQ ID NO: 39865 - RNA, 20 nt, Homo sapiens
aaacuccacauccuguggga

SEQ ID NO: 39866 - RNA, 19 nt, Homo sapiens
aaacugcacugucaagaug

SEQ ID NO: 39867 - RNA, 19 nt, Homo sapiens
aaacuggguuccugcaaug

SEQ ID NO: 39868 - RNA, 18 nt, Homo sapiens
aaacuuuaugcuaaguga

SEQ ID NO: 39869 - RNA, 20 nt, Homo sapiens
aaacuuuaugcuaagugaaa

SEQ ID NO: 39870 - RNA, 19 nt, Homo sapiens
aaacuuucacaccccagac

SEQ ID NO: 39871 - RNA, 22 nt, Homo sapiens
aaacuuugauuuuauaugcuau

SEQ ID NO: 39872 - RNA, 21 nt, Homo sapiens
aaacuuuuccaaugacauuuu

SEQ ID NO: 39873 - RNA, 13 nt, Homo sapiens
aaacuuuuggaag

SEQ ID NO: 39874 - RNA, 21 nt, Homo sapiens
aaagaaaaucaggcuggccaa

SEQ ID NO: 39875 - RNA, 13 nt, Homo sapiens
aaagaaacauuug

SEQ ID NO: 39876 - RNA, 16 nt, Homo sapiens
aaagaaacauuuggua

SEQ ID NO: 39877 - RNA, 13 nt, Homo sapiens
aaagaacaggaaa

SEQ ID NO: 39878 - RNA, 12 nt, Homo sapiens
aaagaagagccg

SEQ ID NO: 39879 - RNA, 15 nt, Homo sapiens
aaagacaaagacaaa

SEQ ID NO: 39880 - RNA, 17 nt, Homo sapiens
aaagacuaugaggaaua

SEQ ID NO: 39881 - RNA, 14 nt, Homo sapiens
aaagacuccaaaga

SEQ ID NO: 39882 - RNA, 15 nt, Homo sapiens
aaagaggcagcuuga

SEQ ID NO: 39883 - RNA, 13 nt, Homo sapiens
aaagauacaguua

SEQ ID NO: 39884 - RNA, 15 nt, Homo sapiens
aaagauacaguuacu

SEQ ID NO: 39885 - RNA, 19 nt, Homo sapiens
aaagaucugcaacuacuau

SEQ ID NO: 39886 - RNA, 13 nt, Homo sapiens
aaagaugaauguc

SEQ ID NO: 39887 - RNA, 15 nt, Homo sapiens
aaagcacugacuucu

SEQ ID NO: 39888 - RNA, 16 nt, Homo sapiens
aaagcagggacuugaa

SEQ ID NO: 39889 - RNA, 14 nt, Homo sapiens
aaagcaugugagac

SEQ ID NO: 39890 - RNA, 17 nt, Homo sapiens
aaagcauuguaacuuau

SEQ ID NO: 39891 - RNA, 16 nt, Homo sapiens
aaagccaaaaaccaaa

SEQ ID NO: 39892 - RNA, 18 nt, Homo sapiens
aaagcugaguguuucaca

SEQ ID NO: 39893 - RNA, 16 nt, Homo sapiens
aaagcuuugugcagau

SEQ ID NO: 39894 - RNA, 17 nt, Homo sapiens
aaaggaagguucuggug

SEQ ID NO: 39895 - RNA, 18 nt, Homo sapiens
aaaggaugcacagaguug

SEQ ID NO: 39896 - RNA, 14 nt, Homo sapiens
aaaggccugucccu

SEQ ID NO: 39897 - RNA, 10 nt, Homo sapiens
aaagggaugg

SEQ ID NO: 39898 - RNA, 12 nt, Homo sapiens
aaagggauggca

SEQ ID NO: 39899 - RNA, 18 nt, Homo sapiens
aaagggcuguuauaaucu

SEQ ID NO: 39900 - RNA, 22 nt, Homo sapiens
aaagggucucccucuguugcca

SEQ ID NO: 39901 - RNA, 11 nt, Homo sapiens
aaaggugacca

SEQ ID NO: 39902 - RNA, 17 nt, Homo sapiens
aaagucagugcccaacu

SEQ ID NO: 39903 - RNA, 23 nt, Homo sapiens
aaagucagugcccaacuguuaua

SEQ ID NO: 39904 - RNA, 17 nt, Homo sapiens
aaaguguaaguucacaa

SEQ ID NO: 39905 - RNA, 17 nt, Homo sapiens
aaagugugacucauuaa

SEQ ID NO: 39906 - RNA, 14 nt, Homo sapiens
aaaguucuagugac

SEQ ID NO: 39907 - RNA, 21 nt, Homo sapiens
aaaguuuuggaaacguauuca

SEQ ID NO: 39908 - RNA, 15 nt, Homo sapiens
aaauaaaagcacuua

SEQ ID NO: 39909 - RNA, 21 nt, Homo sapiens
aaauaacuaggcguggacuua

SEQ ID NO: 39910 - RNA, 17 nt, Homo sapiens
aaauaagccagacauca

SEQ ID NO: 39911 - RNA, 13 nt, Homo sapiens
aaauaaugaaaua

SEQ ID NO: 39912 - RNA, 18 nt, Homo sapiens
aaauaauuuuuauauuug

SEQ ID NO: 39913 - RNA, 23 nt, Homo sapiens
aaauacacuguuaucuucacuuu

SEQ ID NO: 39914 - RNA, 15 nt, Homo sapiens
aaauaccagccagua

SEQ ID NO: 39915 - RNA, 12 nt, Homo sapiens
aaauagugucug

SEQ ID NO: 39916 - RNA, 13 nt, Homo sapiens
aaauagugucuga

SEQ ID NO: 39917 - RNA, 19 nt, Homo sapiens
aaauaguuuaugauuccac

SEQ ID NO: 39918 - RNA, 17 nt, Homo sapiens
aaauauaauaugcacac

SEQ ID NO: 39919 - RNA, 16 nt, Homo sapiens
aaauauaggaacuuaa

SEQ ID NO: 39920 - RNA, 23 nt, Homo sapiens
aaauauugacuuuuuauggcacu

SEQ ID NO: 39921 - RNA, 23 nt, Homo sapiens
aaauauuguugacaacugugacu

SEQ ID NO: 39922 - RNA, 20 nt, Homo sapiens
aaauauuuuuaugugcaaua

SEQ ID NO: 39923 - RNA, 22 nt, Homo sapiens
aaauauuuuuaugugcaauaaa

SEQ ID NO: 39924 - RNA, 19 nt, Homo sapiens
aaaucaaauaugcaaagca

SEQ ID NO: 39925 - RNA, 18 nt, Homo sapiens
aaaucacaaacucaucca

SEQ ID NO: 39926 - RNA, 15 nt, Homo sapiens
aaaucuuaacuugaa

SEQ ID NO: 39927 - RNA, 15 nt, Homo sapiens
aaaugauaauuugcu

SEQ ID NO: 39928 - RNA, 13 nt, Homo sapiens
aaaugauguuuca

SEQ ID NO: 39929 - RNA, 18 nt, Homo sapiens
aaaugauuucacagugug

SEQ ID NO: 39930 - RNA, 16 nt, Homo sapiens
aaaugcugguuuuuca

SEQ ID NO: 39931 - RNA, 23 nt, Homo sapiens
aaaugcugguuuuucaguuuuca

SEQ ID NO: 39932 - RNA, 15 nt, Homo sapiens
aaauggagugacuua

SEQ ID NO: 39933 - RNA, 17 nt, Homo sapiens
aaauggauaugacacau

SEQ ID NO: 39934 - RNA, 20 nt, Homo sapiens
aaaugggcuacuuuguccuu

SEQ ID NO: 39935 - RNA, 16 nt, Homo sapiens
aaaugggggugcauuu

SEQ ID NO: 39936 - RNA, 18 nt, Homo sapiens
aaaugggggugcauuuga

SEQ ID NO: 39937 - RNA, 13 nt, Homo sapiens
aaauguacagcaa

SEQ ID NO: 39938 - RNA, 11 nt, Homo sapiens
aaauguauucu

SEQ ID NO: 39939 - RNA, 21 nt, Homo sapiens
aaauguauucuuuuaguuuuu

SEQ ID NO: 39940 - RNA, 22 nt, Homo sapiens
aaaugucauuguucuugugaac

SEQ ID NO: 39941 - RNA, 12 nt, Homo sapiens
aaaugugcaaua

SEQ ID NO: 39942 - RNA, 21 nt, Homo sapiens
aaauguucaucaaugaaugaa

SEQ ID NO: 39943 - RNA, 11 nt, Homo sapiens
aaauuaacuuu

SEQ ID NO: 39944 - RNA, 23 nt, Homo sapiens
aaauucgcugcaaccuguugaua

SEQ ID NO: 39945 - RNA, 19 nt, Homo sapiens
aaauugaaaggcauucucu

SEQ ID NO: 39946 - RNA, 14 nt, Homo sapiens
aaauuuaaauggag

SEQ ID NO: 39947 - RNA, 21 nt, Homo sapiens
aaauuugguucuaggccgggc

SEQ ID NO: 39948 - RNA, 16 nt, Homo sapiens
aaauuuuauagugucu

SEQ ID NO: 39949 - RNA, 15 nt, Homo sapiens
aaauuuuuauguaau

SEQ ID NO: 39950 - RNA, 22 nt, Homo sapiens
aaauuuuuucucuaggaaauau

SEQ ID NO: 39951 - RNA, 18 nt, Homo sapiens
aacaacucgaaucacuca

SEQ ID NO: 39952 - RNA, 19 nt, Homo sapiens
aacaacucgaaucacucau

SEQ ID NO: 39953 - RNA, 15 nt, Homo sapiens
aacaaggaugaauua

SEQ ID NO: 39954 - RNA, 17 nt, Homo sapiens
aacaagucagucauuca

SEQ ID NO: 39955 - RNA, 21 nt, Homo sapiens
aacaaugacuuguacucugaa

SEQ ID NO: 39956 - RNA, 17 nt, Homo sapiens
aacaaugcuguauuuua

SEQ ID NO: 39957 - RNA, 13 nt, Homo sapiens
aacacagugucug

SEQ ID NO: 39958 - RNA, 21 nt, Homo sapiens
aacaccaggauuuaaguuuca

SEQ ID NO: 39959 - RNA, 21 nt, Homo sapiens
aacacgagcaggcuacuguca

SEQ ID NO: 39960 - RNA, 12 nt, Homo sapiens
aaaaaaacguau

SEQ ID NO: 39961 - RNA, 12 nt, Homo sapiens
aaaaaaagccaa

SEQ ID NO: 39962 - RNA, 21 nt, Homo sapiens
aaaaaaauuuuauagugucuu

SEQ ID NO: 39963 - RNA, 19 nt, Homo sapiens
aaaaaacaccaggauuuaa

SEQ ID NO: 39964 - RNA, 20 nt, Homo sapiens
aaaaaacguauugcauuuaa

SEQ ID NO: 39965 - RNA, 12 nt, Homo sapiens
aaaaaagccaaa

SEQ ID NO: 39966 - RNA, 14 nt, Homo sapiens
aaaaacguauugca

SEQ ID NO: 39967 - RNA, 15 nt, Homo sapiens
aaaaacguauugcau

SEQ ID NO: 39968 - RNA, 15 nt, Homo sapiens
aaaaagaaacauuug

SEQ ID NO: 39969 - RNA, 16 nt, Homo sapiens
aaaaaggaugcacaga

SEQ ID NO: 39970 - RNA, 15 nt, Homo sapiens
aaaacaggcaaauuc

SEQ ID NO: 39971 - RNA, 20 nt, Homo sapiens
aaaaccaaauuuguauuuaa

SEQ ID NO: 39972 - RNA, 18 nt, Homo sapiens
aaaaccacagcaguugaa

SEQ ID NO: 39973 - RNA, 20 nt, Homo sapiens
aaaacguauugcauuuaauu

SEQ ID NO: 39974 - RNA, 23 nt, Homo sapiens
aaaacguauugcauuuaauuuau

SEQ ID NO: 39975 - RNA, 13 nt, Homo sapiens
aaaacucauuucc

SEQ ID NO: 39976 - RNA, 20 nt, Homo sapiens
aaaacucauuuccuauguaa

SEQ ID NO: 39977 - RNA, 19 nt, Homo sapiens
aaaacuuuaugcuaaguga

SEQ ID NO: 39978 - RNA, 11 nt, Homo sapiens
aaaagacauaa

SEQ ID NO: 39979 - RNA, 15 nt, Homo sapiens
aaaagacuccaaaga

SEQ ID NO: 39980 - RNA, 13 nt, Homo sapiens
aaaagacugacca

SEQ ID NO: 39981 - RNA, 14 nt, Homo sapiens
aaaagacugaccaa

SEQ ID NO: 39982 - RNA, 20 nt, Homo sapiens
aaaagauuguauagugcaug

SEQ ID NO: 39983 - RNA, 12 nt, Homo sapiens
aaaagccaaaaa

SEQ ID NO: 39984 - RNA, 11 nt, Homo sapiens
aaaaggugacc

SEQ ID NO: 39985 - RNA, 15 nt, Homo sapiens
aaaaggugucuugcu

SEQ ID NO: 39986 - RNA, 14 nt, Homo sapiens
aaaaguagaauaaa

SEQ ID NO: 39987 - RNA, 15 nt, Homo sapiens
aaaaguugaauuuua

SEQ ID NO: 39988 - RNA, 16 nt, Homo sapiens
aaaauaauuuuuauau

SEQ ID NO: 39989 - RNA, 20 nt, Homo sapiens
aaaauaauuuuuauauuuga

SEQ ID NO: 39990 - RNA, 14 nt, Homo sapiens
aaaauacauacuau

SEQ ID NO: 39991 - RNA, 14 nt, Homo sapiens
aaaauaccaugcca

SEQ ID NO: 39992 - RNA, 22 nt, Homo sapiens
aaaauauuuguaucacaaaucu

SEQ ID NO: 39993 - RNA, 19 nt, Homo sapiens
aaaaucacaaacucaucca

SEQ ID NO: 39994 - RNA, 19 nt, Homo sapiens
aaaaucauuucugcaucag

SEQ ID NO: 39995 - RNA, 17 nt, Homo sapiens
aaaauccauacauuugu

SEQ ID NO: 39996 - RNA, 19 nt, Homo sapiens
aaaaucucaauauuucaga

SEQ ID NO: 39997 - RNA, 14 nt, Homo sapiens
aaaaugaauaucua

SEQ ID NO: 39998 - RNA, 15 nt, Homo sapiens
aaaauggaauacucu

SEQ ID NO: 39999 - RNA, 16 nt, Homo sapiens
aaaauggugugaccac

SEQ ID NO: 40000 - RNA, 23 nt, Homo sapiens
aaaaugucauuguucuugugaac

SEQ ID NO: 40001 - RNA, 13 nt, Homo sapiens
aaaaugugcaaua

SEQ ID NO: 40002 - RNA, 15 nt, Homo sapiens
aaaaugugcaauaug

SEQ ID NO: 40003 - RNA, 21 nt, Homo sapiens
aaaauuagccgggcauggugg

SEQ ID NO: 40004 - RNA, 17 nt, Homo sapiens
aaaauuaucaauaucua

SEQ ID NO: 40005 - RNA, 12 nt, Homo sapiens
aaacacauuuuu

SEQ ID NO: 40006 - RNA, 15 nt, Homo sapiens
aaacaccaggauuua

SEQ ID NO: 40007 - RNA, 16 nt, Homo sapiens
aaacaccaggauuuaa

SEQ ID NO: 40008 - RNA, 13 nt, Homo sapiens
aaacaccucagcu

SEQ ID NO: 40009 - RNA, 14 nt, Homo sapiens
aaacaccucagcug

SEQ ID NO: 40010 - RNA, 14 nt, Homo sapiens
aaacagaccggggu

SEQ ID NO: 40011 - RNA, 14 nt, Homo sapiens
aaacaguagugaua

SEQ ID NO: 40012 - RNA, 22 nt, Homo sapiens
aaacaucaguuacucugaaggg

SEQ ID NO: 40013 - RNA, 23 nt, Homo sapiens
aaacauccagauacacccaaagu

SEQ ID NO: 40014 - RNA, 23 nt, Homo sapiens
aaacaugcuacacacugcauguu

SEQ ID NO: 40015 - RNA, 24 nt, Homo sapiens
aaacaugcuacacacugcauguuu

SEQ ID NO: 40016 - RNA, 21 nt, Homo sapiens
aaacauugguucuuguauuaa

SEQ ID NO: 40017 - RNA, 14 nt, Homo sapiens
aaaccaaggcuaga

SEQ ID NO: 40018 - RNA, 18 nt, Homo sapiens
aaaccacuuuuugcagcu

SEQ ID NO: 40019 - RNA, 14 nt, Homo sapiens
aaaccuauguuugc

SEQ ID NO: 40020 - RNA, 24 nt, Homo sapiens
aaacguauucaaacaauuugaaua

SEQ ID NO: 40021 - RNA, 14 nt, Homo sapiens
aaacguauugcauu

SEQ ID NO: 40022 - RNA, 17 nt, Homo sapiens
aaacguauugcauuuaa

SEQ ID NO: 40023 - RNA, 12 nt, Homo sapiens
aaacgugauuuu

SEQ ID NO: 40024 - RNA, 23 nt, Homo sapiens
aaacgugauuuuuaaauuaaaua

SEQ ID NO: 40025 - RNA, 18 nt, Homo sapiens
aaacuaggugcugcagcc

SEQ ID NO: 40026 - RNA, 12 nt, Homo sapiens
aaacucauccau

SEQ ID NO: 40027 - RNA, 21 nt, Homo sapiens
aaacugagaugugaacacauc

SEQ ID NO: 40028 - RNA, 22 nt, Homo sapiens
aaacugagaugugaacacauca

SEQ ID NO: 40029 - RNA, 23 nt, Homo sapiens
aaacugauacccuuugaaaaagu

SEQ ID NO: 40030 - RNA, 20 nt, Homo sapiens
aaacuuauccuccaugaaua

SEQ ID NO: 40031 - RNA, 16 nt, Homo sapiens
aaacuuugauuuuaua

SEQ ID NO: 40032 - RNA, 23 nt, Homo sapiens
aaacuuugauuuuauaugcuauu

SEQ ID NO: 40033 - RNA, 24 nt, Homo sapiens
aaacuuugauuuuauaugcuauuu

SEQ ID NO: 40034 - RNA, 15 nt, Homo sapiens
aaacuuuuccaauga

SEQ ID NO: 40035 - RNA, 20 nt, Homo sapiens
aaacuuuuccaaugacauuu

SEQ ID NO: 40036 - RNA, 14 nt, Homo sapiens
aaacuuuuggaagg

SEQ ID NO: 40037 - RNA, 11 nt, Homo sapiens
aaagaacagga

SEQ ID NO: 40038 - RNA, 12 nt, Homo sapiens
aaagaacaggaa

SEQ ID NO: 40039 - RNA, 15 nt, Homo sapiens
aaagaagagccggag

SEQ ID NO: 40040 - RNA, 20 nt, Homo sapiens
aaagauuucuugaguuuugu

SEQ ID NO: 40041 - RNA, 16 nt, Homo sapiens
aaagcagaacagugau

SEQ ID NO: 40042 - RNA, 17 nt, Homo sapiens
aaagcagggacuugaac

SEQ ID NO: 40043 - RNA, 19 nt, Homo sapiens
aaagcagggacuugaaccc

SEQ ID NO: 40044 - RNA, 23 nt, Homo sapiens
aaagcagggacuugaacccauau

SEQ ID NO: 40045 - RNA, 12 nt, Homo sapiens
aaagccaaaaac

SEQ ID NO: 40046 - RNA, 17 nt, Homo sapiens
aaagccaaaaaccaaau

SEQ ID NO: 40047 - RNA, 16 nt, Homo sapiens
aaagccuguguuacug

SEQ ID NO: 40048 - RNA, 17 nt, Homo sapiens
aaagcuaaaguaucugu

SEQ ID NO: 40049 - RNA, 15 nt, Homo sapiens
aaagcugaguguuuc

SEQ ID NO: 40050 - RNA, 16 nt, Homo sapiens
aaagcugaguguuuca

SEQ ID NO: 40051 - RNA, 17 nt, Homo sapiens
aaagcugaguguuucac

SEQ ID NO: 40052 - RNA, 14 nt, Homo sapiens
aaagcuuugugcag

SEQ ID NO: 40053 - RNA, 20 nt, Homo sapiens
aaagcuuugugcagauucuu

SEQ ID NO: 40054 - RNA, 22 nt, Homo sapiens
aaaggccugucccugcagacau

SEQ ID NO: 40055 - RNA, 16 nt, Homo sapiens
aaagggcuguuauaau

SEQ ID NO: 40056 - RNA, 22 nt, Homo sapiens
aaagguauuuauugagcaccug

SEQ ID NO: 40057 - RNA, 23 nt, Homo sapiens
aaagguauuuauugagcaccugc

SEQ ID NO: 40058 - RNA, 14 nt, Homo sapiens
aaagguccuggcaa

SEQ ID NO: 40059 - RNA, 14 nt, Homo sapiens
aaaguaaaggcaaa

SEQ ID NO: 40060 - RNA, 17 nt, Homo sapiens
aaaguagauuaagagau

SEQ ID NO: 40061 - RNA, 20 nt, Homo sapiens
aaaguaugugcauauuuuau

SEQ ID NO: 40062 - RNA, 21 nt, Homo sapiens
aaaguaugugcauauuuuauu

SEQ ID NO: 40063 - RNA, 20 nt, Homo sapiens
aaaguauguuagugcaaauu

SEQ ID NO: 40064 - RNA, 19 nt, Homo sapiens
aaagucagugcccaacugu

SEQ ID NO: 40065 - RNA, 11 nt, Homo sapiens
aaagucccaga

SEQ ID NO: 40066 - RNA, 15 nt, Homo sapiens
aaagucccagaucaa

SEQ ID NO: 40067 - RNA, 22 nt, Homo sapiens
aaagucccagaucaagccugcc

SEQ ID NO: 40068 - RNA, 11 nt, Homo sapiens
aaagugcuggg

SEQ ID NO: 40069 - RNA, 12 nt, Homo sapiens
aaagugcuggga

SEQ ID NO: 40070 - RNA, 12 nt, Homo sapiens
aaaguguauuuu

SEQ ID NO: 40071 - RNA, 13 nt, Homo sapiens
aaaguucuaguga

SEQ ID NO: 40072 - RNA, 16 nt, Homo sapiens
aaaguucuagugaccg

SEQ ID NO: 40073 - RNA, 14 nt, Homo sapiens
aaaguucugcagau

SEQ ID NO: 40074 - RNA, 17 nt, Homo sapiens
aaaguucugcagauaaa

SEQ ID NO: 40075 - RNA, 14 nt, Homo sapiens
aaauaaaagcacuu

SEQ ID NO: 40076 - RNA, 19 nt, Homo sapiens
aaauaaaauuuuuauguaa

SEQ ID NO: 40077 - RNA, 21 nt, Homo sapiens
aaauaauuuuuauauuugaaa

SEQ ID NO: 40078 - RNA, 19 nt, Homo sapiens
aaauacacacucaaaucaa

SEQ ID NO: 40079 - RNA, 14 nt, Homo sapiens
aaauacauacuaua

SEQ ID NO: 40080 - RNA, 22 nt, Homo sapiens
aaauacuguuugagguuuuuaa

SEQ ID NO: 40081 - RNA, 15 nt, Homo sapiens
aaauagcuaagauau

SEQ ID NO: 40082 - RNA, 17 nt, Homo sapiens
aaauagugucugaugaa

SEQ ID NO: 40083 - RNA, 10 nt, Homo sapiens
aaauauaaag

SEQ ID NO: 40084 - RNA, 15 nt, Homo sapiens
aaauauaauaugcac

SEQ ID NO: 40085 - RNA, 24 nt, Homo sapiens
aaauauugacuuuuuauggcacua

SEQ ID NO: 40086 - RNA, 15 nt, Homo sapiens
aaauauuuguaucac

SEQ ID NO: 40087 - RNA, 18 nt, Homo sapiens
aaauauuuuuaugugcaa

SEQ ID NO: 40088 - RNA, 17 nt, Homo sapiens
aaaucaaauuccagaau

SEQ ID NO: 40089 - RNA, 14 nt, Homo sapiens
aaaucauuucugca

SEQ ID NO: 40090 - RNA, 15 nt, Homo sapiens
aaauccauacauuug

SEQ ID NO: 40091 - RNA, 23 nt, Homo sapiens
aaaucggaucuggggcucuggga

SEQ ID NO: 40092 - RNA, 18 nt, Homo sapiens
aaaucuacacuccaguga

SEQ ID NO: 40093 - RNA, 14 nt, Homo sapiens
aaaugagcaaaagu

SEQ ID NO: 40094 - RNA, 19 nt, Homo sapiens
aaaugauuucacagugugu

SEQ ID NO: 40095 - RNA, 16 nt, Homo sapiens
aaauggaaaguaacuc

SEQ ID NO: 40096 - RNA, 18 nt, Homo sapiens
aaauggaauacucuuaua

SEQ ID NO: 40097 - RNA, 14 nt, Homo sapiens
aaauggagacacca

SEQ ID NO: 40098 - RNA, 16 nt, Homo sapiens
aaauggccaaugagau

SEQ ID NO: 40099 - RNA, 17 nt, Homo sapiens
aaaugggggugcauuug

SEQ ID NO: 40100 - RNA, 21 nt, Homo sapiens
aaaugguuaaaagagguuuuu

SEQ ID NO: 40101 - RNA, 17 nt, Homo sapiens
aaauguauucuuuuagu

SEQ ID NO: 40102 - RNA, 14 nt, Homo sapiens
aaaugugccuucau

SEQ ID NO: 40103 - RNA, 22 nt, Homo sapiens
aaauguucuccagucauuaugu

SEQ ID NO: 40104 - RNA, 23 nt, Homo sapiens
aaauguucuccagucauuauguu

SEQ ID NO: 40105 - RNA, 22 nt, Homo sapiens
aaauguugacaugggacauuug

SEQ ID NO: 40106 - RNA, 19 nt, Homo sapiens
aaauguuguuuuaggaaua

SEQ ID NO: 40107 - RNA, 18 nt, Homo sapiens
aaauuaaauaaaauuuuu

SEQ ID NO: 40108 - RNA, 18 nt, Homo sapiens
aaauuauauuuugaacaa

SEQ ID NO: 40109 - RNA, 17 nt, Homo sapiens
aaauucacaaguugugu

SEQ ID NO: 40110 - RNA, 19 nt, Homo sapiens
aaauucccuggccuuucau

SEQ ID NO: 40111 - RNA, 16 nt, Homo sapiens
aacacuaaaaaggcau

SEQ ID NO: 40112 - RNA, 21 nt, Homo sapiens
aacacuaaaaaggcauguaau

SEQ ID NO: 40113 - RNA, 14 nt, Homo sapiens
aacagaacuaugga

SEQ ID NO: 40114 - RNA, 16 nt, Homo sapiens
aacagaagcuuccauu

SEQ ID NO: 40115 - RNA, 15 nt, Homo sapiens
aacaguauccaguac

SEQ ID NO: 40116 - RNA, 17 nt, Homo sapiens
aacauagcaucucagga

SEQ ID NO: 40117 - RNA, 19 nt, Homo sapiens
aacaucaguuacucugaag

SEQ ID NO: 40118 - RNA, 18 nt, Homo sapiens
aacaugagccuuuguugc

SEQ ID NO: 40119 - RNA, 19 nt, Homo sapiens
aacaugccagccacuguga

SEQ ID NO: 40120 - RNA, 14 nt, Homo sapiens
aacauguauguaaa

SEQ ID NO: 40121 - RNA, 13 nt, Homo sapiens
aacauuucucaug

SEQ ID NO: 40122 - RNA, 23 nt, Homo sapiens
aaccaaauuuguauuuaagguau

SEQ ID NO: 40123 - RNA, 12 nt, Homo sapiens
aaccagccuggu

SEQ ID NO: 40124 - RNA, 13 nt, Homo sapiens
aaccagccugguc

SEQ ID NO: 40125 - RNA, 15 nt, Homo sapiens
aaccagccuggucaa

SEQ ID NO: 40126 - RNA, 11 nt, Homo sapiens
aacccaaagug

SEQ ID NO: 40127 - RNA, 19 nt, Homo sapiens
aacccaaagugugacucau

SEQ ID NO: 40128 - RNA, 14 nt, Homo sapiens
aacccagggaagac

SEQ ID NO: 40129 - RNA, 17 nt, Homo sapiens
aacccagggaagacaag

SEQ ID NO: 40130 - RNA, 20 nt, Homo sapiens
aaccguuugugauugccauu

SEQ ID NO: 40131 - RNA, 21 nt, Homo sapiens
aaccucauuccccaaccacuu

SEQ ID NO: 40132 - RNA, 20 nt, Homo sapiens
aaccuccaccuucuggguuc

SEQ ID NO: 40133 - RNA, 20 nt, Homo sapiens
aaccucugugagcaucacag

SEQ ID NO: 40134 - RNA, 11 nt, Homo sapiens
aaccugagccc

SEQ ID NO: 40135 - RNA, 13 nt, Homo sapiens
aaccugagcccca

SEQ ID NO: 40136 - RNA, 15 nt, Homo sapiens
aaccugucccagcga

SEQ ID NO: 40137 - RNA, 24 nt, Homo sapiens
aacguauugcauuuaauuuauuga

SEQ ID NO: 40138 - RNA, 14 nt, Homo sapiens
aacuaaacuuucac

SEQ ID NO: 40139 - RNA, 17 nt, Homo sapiens
aacuagaauuuauucaa

SEQ ID NO: 40140 - RNA, 20 nt, Homo sapiens
aacuaucucauuuccaagca

SEQ ID NO: 40141 - RNA, 14 nt, Homo sapiens
aacucaaauacgug

SEQ ID NO: 40142 - RNA, 17 nt, Homo sapiens
aacucagaaacaucagu

SEQ ID NO: 40143 - RNA, 15 nt, Homo sapiens
aacucauauuuucau

SEQ ID NO: 40144 - RNA, 18 nt, Homo sapiens
aacucauugcaaccucca

SEQ ID NO: 40145 - RNA, 15 nt, Homo sapiens
aacuccagaaaguga

SEQ ID NO: 40146 - RNA, 16 nt, Homo sapiens
aacucuaccugcacac

SEQ ID NO: 40147 - RNA, 19 nt, Homo sapiens
aacugacucuuaagaagac

SEQ ID NO: 40148 - RNA, 13 nt, Homo sapiens
aacugauguaagu

SEQ ID NO: 40149 - RNA, 14 nt, Homo sapiens
aacugcacugucaa

SEQ ID NO: 40150 - RNA, 23 nt, Homo sapiens
aacugcagcgaguacuucccgcu

SEQ ID NO: 40151 - RNA, 12 nt, Homo sapiens
aacugccagcaa

SEQ ID NO: 40152 - RNA, 20 nt, Homo sapiens
aacugccaucauuuacuuuu

SEQ ID NO: 40153 - RNA, 17 nt, Homo sapiens
aacuggauuaaacuuaa

SEQ ID NO: 40154 - RNA, 14 nt, Homo sapiens
aacuggcaguuuuc

SEQ ID NO: 40155 - RNA, 17 nt, Homo sapiens
aacuggcaguuuuccau

SEQ ID NO: 40156 - RNA, 12 nt, Homo sapiens
aacugugacugu

SEQ ID NO: 40157 - RNA, 22 nt, Homo sapiens
aacuguuauuuauaaucacuuu

SEQ ID NO: 40158 - RNA, 19 nt, Homo sapiens
aacuguuuagaugaauguc

SEQ ID NO: 40159 - RNA, 16 nt, Homo sapiens
aacuuacuuaguguua

SEQ ID NO: 40160 - RNA, 15 nt, Homo sapiens
aacuuauuuguacau

SEQ ID NO: 40161 - RNA, 16 nt, Homo sapiens
aacuuauuuguacauu

SEQ ID NO: 40162 - RNA, 14 nt, Homo sapiens
aacuucagcgguuu

SEQ ID NO: 40163 - RNA, 22 nt, Homo sapiens
aacuuccuuggacucauuuuaa

SEQ ID NO: 40164 - RNA, 16 nt, Homo sapiens
aacuuucacaccccag

SEQ ID NO: 40165 - RNA, 22 nt, Homo sapiens
aacuuuuauaaacuuuaccuuu

SEQ ID NO: 40166 - RNA, 20 nt, Homo sapiens
aacuuuuccaaugacauuuu

SEQ ID NO: 40167 - RNA, 18 nt, Homo sapiens
aacuuuuuguuuuguuuc

SEQ ID NO: 40168 - RNA, 18 nt, Homo sapiens
aagaaaggccagcaaauu

SEQ ID NO: 40169 - RNA, 13 nt, Homo sapiens
aagaaauauuccu

SEQ ID NO: 40170 - RNA, 13 nt, Homo sapiens
aagaaauucugca

SEQ ID NO: 40171 - RNA, 16 nt, Homo sapiens
aagaacuuauuuguac

SEQ ID NO: 40172 - RNA, 13 nt, Homo sapiens
aagaagacugcau

SEQ ID NO: 40173 - RNA, 15 nt, Homo sapiens
aagaagagccggagc

SEQ ID NO: 40174 - RNA, 14 nt, Homo sapiens
aagaaguugauaug

SEQ ID NO: 40175 - RNA, 16 nt, Homo sapiens
aagaaugacuaugcaa

SEQ ID NO: 40176 - RNA, 14 nt, Homo sapiens
aagacaaaaagcua

SEQ ID NO: 40177 - RNA, 20 nt, Homo sapiens
aagaccuggucgucgucuug

SEQ ID NO: 40178 - RNA, 20 nt, Homo sapiens
aagacuauucaaacagucuc

SEQ ID NO: 40179 - RNA, 13 nt, Homo sapiens
aagacuccaaaga

SEQ ID NO: 40180 - RNA, 11 nt, Homo sapiens
aagacugacca

SEQ ID NO: 40181 - RNA, 22 nt, Homo sapiens
aagagaacaagcaaauauaaac

SEQ ID NO: 40182 - RNA, 18 nt, Homo sapiens
aagagagacacagcugca

SEQ ID NO: 40183 - RNA, 15 nt, Homo sapiens
aagagauggguuuga

SEQ ID NO: 40184 - RNA, 12 nt, Homo sapiens
aagagccggagc

SEQ ID NO: 40185 - RNA, 18 nt, Homo sapiens
aagagccggagccuccag

SEQ ID NO: 40186 - RNA, 22 nt, Homo sapiens
aagagccggagccuccagcugc

SEQ ID NO: 40187 - RNA, 23 nt, Homo sapiens
aagagccggagccuccagcugcc

SEQ ID NO: 40188 - RNA, 16 nt, Homo sapiens
aagaggcagcuugaaa

SEQ ID NO: 40189 - RNA, 17 nt, Homo sapiens
aagagguuuuaaagcuu

SEQ ID NO: 40190 - RNA, 14 nt, Homo sapiens
aagaguggguuuca

SEQ ID NO: 40191 - RNA, 22 nt, Homo sapiens
aagaguggguuucacaagugaa

SEQ ID NO: 40192 - RNA, 16 nt, Homo sapiens
aagaguuccuucugcu

SEQ ID NO: 40193 - RNA, 17 nt, Homo sapiens
aagauacugaaauaaac

SEQ ID NO: 40194 - RNA, 18 nt, Homo sapiens
aagaucugcaacuacuau

SEQ ID NO: 40195 - RNA, 22 nt, Homo sapiens
aagaucuuuuuccagguuccug

SEQ ID NO: 40196 - RNA, 11 nt, Homo sapiens
aagaugaaaau

SEQ ID NO: 40197 - RNA, 17 nt, Homo sapiens
aagaugagugagcaugc

SEQ ID NO: 40198 - RNA, 16 nt, Homo sapiens
aagaugaugaugaucu

SEQ ID NO: 40199 - RNA, 22 nt, Homo sapiens
aagaugugggcagugaugucac

SEQ ID NO: 40200 - RNA, 15 nt, Homo sapiens
aagauuaugaucuca

SEQ ID NO: 40201 - RNA, 23 nt, Homo sapiens
aagauucaaugccccugaauuua

SEQ ID NO: 40202 - RNA, 16 nt, Homo sapiens
aagauucuauguuaau

SEQ ID NO: 40203 - RNA, 14 nt, Homo sapiens
aagauuuaccacuu

SEQ ID NO: 40204 - RNA, 12 nt, Homo sapiens
aagcaaauauaa

SEQ ID NO: 40205 - RNA, 14 nt, Homo sapiens
aagcaaauggccaa

SEQ ID NO: 40206 - RNA, 13 nt, Homo sapiens
aagcaacaucuag

SEQ ID NO: 40207 - RNA, 20 nt, Homo sapiens
aagcaacaucuagcaaaugu

SEQ ID NO: 40208 - RNA, 18 nt, Homo sapiens
aagcaacccaaauguuca

SEQ ID NO: 40209 - RNA, 14 nt, Homo sapiens
aagcaaguauuaga

SEQ ID NO: 40210 - RNA, 20 nt, Homo sapiens
aagcacagugaucaaguuau

SEQ ID NO: 40211 - RNA, 21 nt, Homo sapiens
aagcacuuuaacacagugucu

SEQ ID NO: 40212 - RNA, 21 nt, Homo sapiens
aagcacuuucccucuuggugc

SEQ ID NO: 40213 - RNA, 20 nt, Homo sapiens
aagcagaacagugauuacca

SEQ ID NO: 40214 - RNA, 17 nt, Homo sapiens
aagcaugggccuagccc

SEQ ID NO: 40215 - RNA, 11 nt, Homo sapiens
aagcauuguaa

SEQ ID NO: 40216 - RNA, 14 nt, Homo sapiens
aagccagacaucaa

SEQ ID NO: 40217 - RNA, 18 nt, Homo sapiens
aagccaucggagcugcua

SEQ ID NO: 40218 - RNA, 20 nt, Homo sapiens
aagccaucggagcugcuaga

SEQ ID NO: 40219 - RNA, 15 nt, Homo sapiens
aagcccaauauuaua

SEQ ID NO: 40220 - RNA, 14 nt, Homo sapiens
aagccucaugucca

SEQ ID NO: 40221 - RNA, 16 nt, Homo sapiens
aagccucuauugccau

SEQ ID NO: 40222 - RNA, 15 nt, Homo sapiens
aagccuguguuacug

SEQ ID NO: 40223 - RNA, 19 nt, Homo sapiens
aagccuuggggcugaugca

SEQ ID NO: 40224 - RNA, 19 nt, Homo sapiens
aagcuguuuccauagggug

SEQ ID NO: 40225 - RNA, 22 nt, Homo sapiens
aagcuuccauuccaagccugac

SEQ ID NO: 40226 - RNA, 21 nt, Homo sapiens
aaggaaacuggguuccugcaa

SEQ ID NO: 40227 - RNA, 23 nt, Homo sapiens
aaggaaacuggguuccugcaaug

SEQ ID NO: 40228 - RNA, 23 nt, Homo sapiens
aaggaagaaauuccaggaaaauc

SEQ ID NO: 40229 - RNA, 13 nt, Homo sapiens
aaggaagguucug

SEQ ID NO: 40230 - RNA, 23 nt, Homo sapiens
aaggaagguucuggugugaacua

SEQ ID NO: 40231 - RNA, 23 nt, Homo sapiens
aaggaccauaaauuuaaauggag

SEQ ID NO: 40232 - RNA, 15 nt, Homo sapiens
aaggagcucccagga

SEQ ID NO: 40233 - RNA, 19 nt, Homo sapiens
aaggauuuuaugcuuuaaa

SEQ ID NO: 40234 - RNA, 19 nt, Homo sapiens
aaggcagcucuaaauguca

SEQ ID NO: 40235 - RNA, 20 nt, Homo sapiens
aaggcauauuuaacaaaauu

SEQ ID NO: 40236 - RNA, 16 nt, Homo sapiens
aaggccagcaaauucg

SEQ ID NO: 40237 - RNA, 20 nt, Homo sapiens
aaggcccccgggccgacgga

SEQ ID NO: 40238 - RNA, 20 nt, Homo sapiens
aaggcuaccuuuguauucuc

SEQ ID NO: 40239 - RNA, 15 nt, Homo sapiens
aaggcuccugagaca

SEQ ID NO: 40240 - RNA, 22 nt, Homo sapiens
aaggcuccugagacacaugggu

SEQ ID NO: 40241 - RNA, 12 nt, Homo sapiens
aaggcuggagug

SEQ ID NO: 40242 - RNA, 13 nt, Homo sapiens
aaggcuggagugc

SEQ ID NO: 40243 - RNA, 15 nt, Homo sapiens
aaggcuggagugcag

SEQ ID NO: 40244 - RNA, 20 nt, Homo sapiens
aaggcuuagacccucaugcu

SEQ ID NO: 40245 - RNA, 23 nt, Homo sapiens
aaggcuuagacccucaugcugcc

SEQ ID NO: 40246 - RNA, 23 nt, Homo sapiens
aaggcuucucuuaaacacuaaaa

SEQ ID NO: 40247 - RNA, 23 nt, Homo sapiens
aagggaacugaacauuccagagc

SEQ ID NO: 40248 - RNA, 14 nt, Homo sapiens
aaggggcggcggcc

SEQ ID NO: 40249 - RNA, 22 nt, Homo sapiens
aaggggcggcggcccugugcgg

SEQ ID NO: 40250 - RNA, 14 nt, Homo sapiens
aaggguaauuauau

SEQ ID NO: 40251 - RNA, 21 nt, Homo sapiens
aagggucucccucuguugcca

SEQ ID NO: 40252 - RNA, 20 nt, Homo sapiens
aagguaaaauugaaaggcau

SEQ ID NO: 40253 - RNA, 18 nt, Homo sapiens
aagguauuuauugagcac

SEQ ID NO: 40254 - RNA, 19 nt, Homo sapiens
aagguauuuuaaucaccaa

SEQ ID NO: 40255 - RNA, 19 nt, Homo sapiens
aagguuaugauugaaucua

SEQ ID NO: 40256 - RNA, 20 nt, Homo sapiens
aagguuaugauugaaucuac

SEQ ID NO: 40257 - RNA, 12 nt, Homo sapiens
aaguaaaaccac

SEQ ID NO: 40258 - RNA, 13 nt, Homo sapiens
aaguaaaaccaca

SEQ ID NO: 40259 - RNA, 15 nt, Homo sapiens
aaguaaaaccacagc

SEQ ID NO: 40260 - RNA, 12 nt, Homo sapiens
aaguaauuucag

SEQ ID NO: 40261 - RNA, 13 nt, Homo sapiens
aaguacagacuuu

SEQ ID NO: 40262 - RNA, 12 nt, Homo sapiens
aaguacucauac

SEQ ID NO: 40263 - RNA, 14 nt, Homo sapiens
aaguagggacuucu

SEQ ID NO: 40264 - RNA, 18 nt, Homo sapiens
aaguagggacuucugucu

SEQ ID NO: 40265 - RNA, 17 nt, Homo sapiens
aaguaucccuacuguaa

SEQ ID NO: 40266 - RNA, 19 nt, Homo sapiens
aaguaucccuacuguaauu

SEQ ID NO: 40267 - RNA, 19 nt, Homo sapiens
aaguauccuucagccugaa

SEQ ID NO: 40268 - RNA, 13 nt, Homo sapiens
aaguauuuuauua

SEQ ID NO: 40269 - RNA, 15 nt, Homo sapiens
aaguccaagcauuua

SEQ ID NO: 40270 - RNA, 14 nt, Homo sapiens
aagucccugcugcc

SEQ ID NO: 40271 - RNA, 11 nt, Homo sapiens
aagucuguuuu

SEQ ID NO: 40272 - RNA, 21 nt, Homo sapiens
aagucuguuuuaugacuucau

SEQ ID NO: 40273 - RNA, 11 nt, Homo sapiens
aagucuuccau

SEQ ID NO: 40274 - RNA, 23 nt, Homo sapiens
aagucuuccauagagacuuugug

SEQ ID NO: 40275 - RNA, 16 nt, Homo sapiens
aagugaaaaacaucca

SEQ ID NO: 40276 - RNA, 17 nt, Homo sapiens
aagugaaaaacauccag

SEQ ID NO: 40277 - RNA, 16 nt, Homo sapiens
aagugaaauaagccag

SEQ ID NO: 40278 - RNA, 17 nt, Homo sapiens
aagugaaauaagccaga

SEQ ID NO: 40279 - RNA, 15 nt, Homo sapiens
aagugcugggaauua

SEQ ID NO: 40280 - RNA, 22 nt, Homo sapiens
aagugguauagaaaugcugguu

SEQ ID NO: 40281 - RNA, 16 nt, Homo sapiens
aaguuauuuuuaauuu

SEQ ID NO: 40282 - RNA, 11 nt, Homo sapiens
aaguucugcag

SEQ ID NO: 40283 - RNA, 16 nt, Homo sapiens
aaguuuaauugacuua

SEQ ID NO: 40284 - RNA, 12 nt, Homo sapiens
aaguuuaugcau

SEQ ID NO: 40285 - RNA, 18 nt, Homo sapiens
aaguuuaugcauacagua

SEQ ID NO: 40286 - RNA, 19 nt, Homo sapiens
aaguuuaugcauacaguaa

SEQ ID NO: 40287 - RNA, 23 nt, Homo sapiens
aaguuuuuauggcuuuugugcau

SEQ ID NO: 40288 - RNA, 16 nt, Homo sapiens
aauaaaaaauguaagu

SEQ ID NO: 40289 - RNA, 16 nt, Homo sapiens
aauaaaaaggugacca

SEQ ID NO: 40290 - RNA, 12 nt, Homo sapiens
aauaaaccuaug

SEQ ID NO: 40291 - RNA, 16 nt, Homo sapiens
aauaaaugugccuuca

SEQ ID NO: 40292 - RNA, 22 nt, Homo sapiens
aauaaauucccuggccuuucau

SEQ ID NO: 40293 - RNA, 16 nt, Homo sapiens
aauaauacaccagaga

SEQ ID NO: 40294 - RNA, 22 nt, Homo sapiens
aauaauuuuuauauuugaaaua

SEQ ID NO: 40295 - RNA, 18 nt, Homo sapiens
aauacaccacuacauucu

SEQ ID NO: 40296 - RNA, 20 nt, Homo sapiens
aauacauaaaguaugugcau

SEQ ID NO: 40297 - RNA, 17 nt, Homo sapiens
aauagaaauaaaccuau

SEQ ID NO: 40298 - RNA, 18 nt, Homo sapiens
aauagaaauaaaccuaug

SEQ ID NO: 40299 - RNA, 22 nt, Homo sapiens
aauagaaggauguacauuucca

SEQ ID NO: 40300 - RNA, 15 nt, Homo sapiens
aauagugucugauga

SEQ ID NO: 40301 - RNA, 16 nt, Homo sapiens
aauagugucugaugaa

SEQ ID NO: 40302 - RNA, 17 nt, Homo sapiens
aauaguucaaagccaag

SEQ ID NO: 40303 - RNA, 15 nt, Homo sapiens
aauauauaaccagug

SEQ ID NO: 40304 - RNA, 14 nt, Homo sapiens
aauauauauuuuag

SEQ ID NO: 40305 - RNA, 12 nt, Homo sapiens
aauauauuuccu

SEQ ID NO: 40306 - RNA, 18 nt, Homo sapiens
aauauauuuccuuauuca

SEQ ID NO: 40307 - RNA, 19 nt, Homo sapiens
aauauauuuuuagacucau

SEQ ID NO: 40308 - RNA, 17 nt, Homo sapiens
aauaucaguuauuuuua

SEQ ID NO: 40309 - RNA, 18 nt, Homo sapiens
aauaucaguuauuuuuaa

SEQ ID NO: 40310 - RNA, 22 nt, Homo sapiens
aauaucccuuggacauuuuaug

SEQ ID NO: 40311 - RNA, 23 nt, Homo sapiens
aauaucccuuggacauuuuaugu

SEQ ID NO: 40312 - RNA, 15 nt, Homo sapiens
aauaucuuaucuucc

SEQ ID NO: 40313 - RNA, 21 nt, Homo sapiens
aauaugccccauucaacaucu

SEQ ID NO: 40314 - RNA, 23 nt, Homo sapiens
aauauguaaauagaaacguguau

SEQ ID NO: 40315 - RNA, 14 nt, Homo sapiens
aauauuauguuaaa

SEQ ID NO: 40316 - RNA, 17 nt, Homo sapiens
aauauuauguuaaaacu

SEQ ID NO: 40317 - RNA, 17 nt, Homo sapiens
aauauuuauuaccucug

SEQ ID NO: 40318 - RNA, 20 nt, Homo sapiens
aauauuuauuaccucugaua

SEQ ID NO: 40319 - RNA, 20 nt, Homo sapiens
aauauuuauuauuuucaccu

SEQ ID NO: 40320 - RNA, 21 nt, Homo sapiens
aauauuuauuuuaauaauguu

SEQ ID NO: 40321 - RNA, 18 nt, Homo sapiens
aauauuugcaagacauag

SEQ ID NO: 40322 - RNA, 19 nt, Homo sapiens
aaucaaauuccagaaugau

SEQ ID NO: 40323 - RNA, 19 nt, Homo sapiens
aaucaccaaggcugauuaa

SEQ ID NO: 40324 - RNA, 18 nt, Homo sapiens
aaucacuggcuguuaauc

SEQ ID NO: 40325 - RNA, 23 nt, Homo sapiens
aaucacuggcuguuaaucuuuca

SEQ ID NO: 40326 - RNA, 14 nt, Homo sapiens
aaucagaucauuuc

SEQ ID NO: 40327 - RNA, 11 nt, Homo sapiens
aaucaggguua

SEQ ID NO: 40328 - RNA, 12 nt, Homo sapiens
aaucaugaauua

SEQ ID NO: 40329 - RNA, 22 nt, Homo sapiens
aaucaugaauuaguuuuauaug

SEQ ID NO: 40330 - RNA, 16 nt, Homo sapiens
aaucauuucugcauca

SEQ ID NO: 40331 - RNA, 20 nt, Homo sapiens
aaucauuucugcaucagcug

SEQ ID NO: 40332 - RNA, 23 nt, Homo sapiens
aauccaagaaaauggccagugag

SEQ ID NO: 40333 - RNA, 21 nt, Homo sapiens
aauccaagaacuuauuuguac

SEQ ID NO: 40334 - RNA, 15 nt, Homo sapiens
aaucccagcuacuug

SEQ ID NO: 40335 - RNA, 21 nt, Homo sapiens
aauccucucaaccaccuuuca

SEQ ID NO: 40336 - RNA, 18 nt, Homo sapiens
aauccugauucauauuua

SEQ ID NO: 40337 - RNA, 15 nt, Homo sapiens
aauccuugaagauuu

SEQ ID NO: 40338 - RNA, 19 nt, Homo sapiens
aauccuuuguuuucugacu

SEQ ID NO: 40339 - RNA, 13 nt, Homo sapiens
aaucuaaauggaa

SEQ ID NO: 40340 - RNA, 16 nt, Homo sapiens
aaucuacugucaauuu

SEQ ID NO: 40341 - RNA, 12 nt, Homo sapiens
aaucucaaauuu

SEQ ID NO: 40342 - RNA, 13 nt, Homo sapiens
aaucuccaaaaua

SEQ ID NO: 40343 - RNA, 13 nt, Homo sapiens
aaucugagccagu

SEQ ID NO: 40344 - RNA, 20 nt, Homo sapiens
aaucugagccagugcuuuaa

SEQ ID NO: 40345 - RNA, 23 nt, Homo sapiens
aaucugagccagugcuuuaaugg

SEQ ID NO: 40346 - RNA, 22 nt, Homo sapiens
aaucugaggccuccucucucag

SEQ ID NO: 40347 - RNA, 17 nt, Homo sapiens
aaucuucagaccuagaa

SEQ ID NO: 40348 - RNA, 22 nt, Homo sapiens
aaucuuuauaguucuacuccau

SEQ ID NO: 40349 - RNA, 20 nt, Homo sapiens
aaucuuucaaagugucuuga

SEQ ID NO: 40350 - RNA, 13 nt, Homo sapiens
aaugaaguguuua

SEQ ID NO: 40351 - RNA, 15 nt, Homo sapiens
aaugaaugaaugaau

SEQ ID NO: 40352 - RNA, 17 nt, Homo sapiens
aaugaaugaauggcuaa

SEQ ID NO: 40353 - RNA, 16 nt, Homo sapiens
aaugacauuuuguugg

SEQ ID NO: 40354 - RNA, 17 nt, Homo sapiens
aaugacccccaucccau

SEQ ID NO: 40355 - RNA, 19 nt, Homo sapiens
aaugacuaaaaaacaaaga

SEQ ID NO: 40356 - RNA, 22 nt, Homo sapiens
aaugagagacacacugaagaag

SEQ ID NO: 40357 - RNA, 16 nt, Homo sapiens
aaugagaucauuguga

SEQ ID NO: 40358 - RNA, 22 nt, Homo sapiens
aaugauaacuggaaacuucagc

SEQ ID NO: 40359 - RNA, 15 nt, Homo sapiens
aaugauuaugaauua

SEQ ID NO: 40360 - RNA, 21 nt, Homo sapiens
aaugauuaugaauuacauuug

SEQ ID NO: 40361 - RNA, 12 nt, Homo sapiens
aaugauuucaca

SEQ ID NO: 40362 - RNA, 15 nt, Homo sapiens
aaugauuucacagug

SEQ ID NO: 40363 - RNA, 23 nt, Homo sapiens
aaugauuucacagugugugguca

SEQ ID NO: 40364 - RNA, 24 nt, Homo sapiens
aaugauuuuacggagauaucccag

SEQ ID NO: 40365 - RNA, 13 nt, Homo sapiens
aaugcaccuggaa

SEQ ID NO: 40366 - RNA, 21 nt, Homo sapiens
aaugcugguuuuucaguuuuc

SEQ ID NO: 40367 - RNA, 15 nt, Homo sapiens
aauggagacaccacc

SEQ ID NO: 40368 - RNA, 21 nt, Homo sapiens
aauggcuaagcaaaaugugau

SEQ ID NO: 40369 - RNA, 15 nt, Homo sapiens
aaugggggugcauuu

SEQ ID NO: 40370 - RNA, 22 nt, Homo sapiens
aaugguuaaaagagguuuuucu

SEQ ID NO: 40371 - RNA, 15 nt, Homo sapiens
aaugguuccauucuc

SEQ ID NO: 40372 - RNA, 20 nt, Homo sapiens
aauguaagggaaacugccag

SEQ ID NO: 40373 - RNA, 22 nt, Homo sapiens
aauguaagggaaacugccagca

SEQ ID NO: 40374 - RNA, 14 nt, Homo sapiens
aauguagauaaagc

SEQ ID NO: 40375 - RNA, 17 nt, Homo sapiens
aauguagcagcucauaa

SEQ ID NO: 40376 - RNA, 14 nt, Homo sapiens
aauguaugugcaca

SEQ ID NO: 40377 - RNA, 15 nt, Homo sapiens
aauguaugugcacau

SEQ ID NO: 40378 - RNA, 12 nt, Homo sapiens
aauguauucuuu

SEQ ID NO: 40379 - RNA, 21 nt, Homo sapiens
aauguauucuuuuaguuuuua

SEQ ID NO: 40380 - RNA, 24 nt, Homo sapiens
aaugugacuuggauucaauuuuaa

SEQ ID NO: 40381 - RNA, 10 nt, Homo sapiens
aaugugcaau

SEQ ID NO: 40382 - RNA, 11 nt, Homo sapiens
aaugugcaaua

SEQ ID NO: 40383 - RNA, 17 nt, Homo sapiens
aauguucuccagucauu

SEQ ID NO: 40384 - RNA, 22 nt, Homo sapiens
aauguuguuuuaggaauacaua

SEQ ID NO: 40385 - RNA, 14 nt, Homo sapiens
aauuaacacaugau

SEQ ID NO: 40386 - RNA, 16 nt, Homo sapiens
aauuaagagagucuau

SEQ ID NO: 40387 - RNA, 18 nt, Homo sapiens
aauuaauggaauauguaa

SEQ ID NO: 40388 - RNA, 13 nt, Homo sapiens
aauuacaggcgug

SEQ ID NO: 40389 - RNA, 21 nt, Homo sapiens
aauuacaggcgugagccacca

SEQ ID NO: 40390 - RNA, 16 nt, Homo sapiens
aauuacauuuguauaa

SEQ ID NO: 40391 - RNA, 17 nt, Homo sapiens
aauuacauuuguauaaa

SEQ ID NO: 40392 - RNA, 13 nt, Homo sapiens
aauuagccgggca

SEQ ID NO: 40393 - RNA, 19 nt, Homo sapiens
aauuagccgggcauggugg

SEQ ID NO: 40394 - RNA, 15 nt, Homo sapiens
aauuauuucacuuua

SEQ ID NO: 40395 - RNA, 12 nt, Homo sapiens
aauuauuugaag

SEQ ID NO: 40396 - RNA, 18 nt, Homo sapiens
aauuauuugaagauuuaa

SEQ ID NO: 40397 - RNA, 19 nt, Homo sapiens
aauuauuuuuacaguucuc

SEQ ID NO: 40398 - RNA, 13 nt, Homo sapiens
aauuccaauacau

SEQ ID NO: 40399 - RNA, 18 nt, Homo sapiens
aauucccuggccuuucau

SEQ ID NO: 40400 - RNA, 20 nt, Homo sapiens
aauuccuauauccugugacu

SEQ ID NO: 40401 - RNA, 22 nt, Homo sapiens
aauuccuauauccugugacugu

SEQ ID NO: 40402 - RNA, 22 nt, Homo sapiens
aauucgcugcaaccuguugaua

SEQ ID NO: 40403 - RNA, 20 nt, Homo sapiens
aauucucuaguuugauuaaa

SEQ ID NO: 40404 - RNA, 17 nt, Homo sapiens
aauucuuacauguuuuc

SEQ ID NO: 40405 - RNA, 17 nt, Homo sapiens
aauugaaaggcauucuc

SEQ ID NO: 40406 - RNA, 21 nt, Homo sapiens
aauugaauucccugccuggau

SEQ ID NO: 40407 - RNA, 14 nt, Homo sapiens
aauugacacuuaaa

SEQ ID NO: 40408 - RNA, 16 nt, Homo sapiens
aauugacccacaagaa

SEQ ID NO: 40409 - RNA, 13 nt, Homo sapiens
aauugcuaucgcc

SEQ ID NO: 40410 - RNA, 17 nt, Homo sapiens
aauugcuaucgccauca

SEQ ID NO: 40411 - RNA, 14 nt, Homo sapiens
aaauugagcuaggg

SEQ ID NO: 40412 - RNA, 12 nt, Homo sapiens
aaauuggacuua

SEQ ID NO: 40413 - RNA, 20 nt, Homo sapiens
aaauugggaaaggaguagaa

SEQ ID NO: 40414 - RNA, 22 nt, Homo sapiens
aaauuugguucuaggccgggcg

SEQ ID NO: 40415 - RNA, 23 nt, Homo sapiens
aaauuugguucuaggccgggcgc

SEQ ID NO: 40416 - RNA, 14 nt, Homo sapiens
aaauuuuauagugu

SEQ ID NO: 40417 - RNA, 15 nt, Homo sapiens
aaauuuuauaguguc

SEQ ID NO: 40418 - RNA, 16 nt, Homo sapiens
aacaaaaaaagcauug

SEQ ID NO: 40419 - RNA, 13 nt, Homo sapiens
aacaaagaagaca

SEQ ID NO: 40420 - RNA, 15 nt, Homo sapiens
aacaacaacaacaaa

SEQ ID NO: 40421 - RNA, 14 nt, Homo sapiens
aacaacucgaauca

SEQ ID NO: 40422 - RNA, 15 nt, Homo sapiens
aacaacucgaaucac

SEQ ID NO: 40423 - RNA, 16 nt, Homo sapiens
aacaacucgaaucacu

SEQ ID NO: 40424 - RNA, 21 nt, Homo sapiens
aacacagugucuggcacuugg

SEQ ID NO: 40425 - RNA, 18 nt, Homo sapiens
aacacaugauccugcaau

SEQ ID NO: 40426 - RNA, 14 nt, Homo sapiens
aacagaagcuucca

SEQ ID NO: 40427 - RNA, 22 nt, Homo sapiens
aacagaccgggguucccgugug

SEQ ID NO: 40428 - RNA, 17 nt, Homo sapiens
aacagcuccaccuuacu

SEQ ID NO: 40429 - RNA, 14 nt, Homo sapiens
aacagucucaggaa

SEQ ID NO: 40430 - RNA, 15 nt, Homo sapiens
aacauagcaucucag

SEQ ID NO: 40431 - RNA, 10 nt, Homo sapiens
aacauagguu

SEQ ID NO: 40432 - RNA, 20 nt, Homo sapiens
aacaugccagccacugugau

SEQ ID NO: 40433 - RNA, 14 nt, Homo sapiens
aacauguucacuua

SEQ ID NO: 40434 - RNA, 16 nt, Homo sapiens
aacauuucaaaaggua

SEQ ID NO: 40435 - RNA, 22 nt, Homo sapiens
aacauuugguaaggggaauuga

SEQ ID NO: 40436 - RNA, 20 nt, Homo sapiens
aaccaaauggagugacuuag

SEQ ID NO: 40437 - RNA, 21 nt, Homo sapiens
aaccaaauggagugacuuagu

SEQ ID NO: 40438 - RNA, 13 nt, Homo sapiens
aaccaccuuucag

SEQ ID NO: 40439 - RNA, 22 nt, Homo sapiens
aaccaccuuucagauaacuguu

SEQ ID NO: 40440 - RNA, 18 nt, Homo sapiens
aaccacuucauucuugaa

SEQ ID NO: 40441 - RNA, 17 nt, Homo sapiens
aaccagagccugagugu

SEQ ID NO: 40442 - RNA, 21 nt, Homo sapiens
aaccagagccugaguguugcc

SEQ ID NO: 40443 - RNA, 14 nt, Homo sapiens
aaccagcagaaaug

SEQ ID NO: 40444 - RNA, 15 nt, Homo sapiens
aaccaugcccaagaa

SEQ ID NO: 40445 - RNA, 23 nt, Homo sapiens
aacccaaagugugacucauuaaa

SEQ ID NO: 40446 - RNA, 15 nt, Homo sapiens
aacccaaauguucau

SEQ ID NO: 40447 - RNA, 22 nt, Homo sapiens
aacccaaauguucaucaaugaa

SEQ ID NO: 40448 - RNA, 20 nt, Homo sapiens
aacccaggagauggaaguug

SEQ ID NO: 40449 - RNA, 15 nt, Homo sapiens
aacccagggaagaca

SEQ ID NO: 40450 - RNA, 15 nt, Homo sapiens
aaccccaucauccuc

SEQ ID NO: 40451 - RNA, 13 nt, Homo sapiens
aacccggccugau

SEQ ID NO: 40452 - RNA, 16 nt, Homo sapiens
aacccggccugauuaa

SEQ ID NO: 40453 - RNA, 22 nt, Homo sapiens
aacccggccugauuaaaguuaa

SEQ ID NO: 40454 - RNA, 12 nt, Homo sapiens
aacccugucucu

SEQ ID NO: 40455 - RNA, 19 nt, Homo sapiens
aaccguuugugauugccau

SEQ ID NO: 40456 - RNA, 15 nt, Homo sapiens
aaccucauuaucagu

SEQ ID NO: 40457 - RNA, 15 nt, Homo sapiens
aaccucauuccccaa

SEQ ID NO: 40458 - RNA, 18 nt, Homo sapiens
aaccucauuccccaacca

SEQ ID NO: 40459 - RNA, 11 nt, Homo sapiens
aaccuccaccu

SEQ ID NO: 40460 - RNA, 19 nt, Homo sapiens
aaccuccaccuucuggguu

SEQ ID NO: 40461 - RNA, 15 nt, Homo sapiens
aaccucucccaacua

SEQ ID NO: 40462 - RNA, 18 nt, Homo sapiens
aaccucucccaacuauaa

SEQ ID NO: 40463 - RNA, 22 nt, Homo sapiens
aaccuguugauagcaagugaau

SEQ ID NO: 40464 - RNA, 18 nt, Homo sapiens
aaccuuauuguaccucuc

SEQ ID NO: 40465 - RNA, 15 nt, Homo sapiens
aaccuuuacauccag

SEQ ID NO: 40466 - RNA, 17 nt, Homo sapiens
aaccuuuacauccagau

SEQ ID NO: 40467 - RNA, 16 nt, Homo sapiens
aacggaacaguaucca

SEQ ID NO: 40468 - RNA, 13 nt, Homo sapiens
aacggucucucac

SEQ ID NO: 40469 - RNA, 16 nt, Homo sapiens
aacgucccuagcccuu

SEQ ID NO: 40470 - RNA, 13 nt, Homo sapiens
aacuaaaauguuc

SEQ ID NO: 40471 - RNA, 15 nt, Homo sapiens
aacuaaaauguucua

SEQ ID NO: 40472 - RNA, 16 nt, Homo sapiens
aacuauaaaacuaggu

SEQ ID NO: 40473 - RNA, 19 nt, Homo sapiens
aacuauaaaacuaggugcu

SEQ ID NO: 40474 - RNA, 15 nt, Homo sapiens
aacuauauuguuugc

SEQ ID NO: 40475 - RNA, 16 nt, Homo sapiens
aacuaucucauuucca

SEQ ID NO: 40476 - RNA, 21 nt, Homo sapiens
aacucaaggaaaucuguguca

SEQ ID NO: 40477 - RNA, 15 nt, Homo sapiens
aacucagaaacauca

SEQ ID NO: 40478 - RNA, 16 nt, Homo sapiens
aacucagaaacaucag

SEQ ID NO: 40479 - RNA, 13 nt, Homo sapiens
aacucauuuccua

SEQ ID NO: 40480 - RNA, 17 nt, Homo sapiens
aacuccacauccugugg

SEQ ID NO: 40481 - RNA, 18 nt, Homo sapiens
aacuccacauccuguggg

SEQ ID NO: 40482 - RNA, 15 nt, Homo sapiens
aacugaacauuccag

SEQ ID NO: 40483 - RNA, 20 nt, Homo sapiens
aacugacucuuaagaagacu

SEQ ID NO: 40484 - RNA, 15 nt, Homo sapiens
aacugcagcgaguac

SEQ ID NO: 40485 - RNA, 20 nt, Homo sapiens
aacugcagcgaguacuuccc

SEQ ID NO: 40486 - RNA, 14 nt, Homo sapiens
aacugcauugagaa

SEQ ID NO: 40487 - RNA, 18 nt, Homo sapiens
aacugccaucauuuacuu

SEQ ID NO: 40488 - RNA, 16 nt, Homo sapiens
aacuggaaauaaaaga

SEQ ID NO: 40489 - RNA, 17 nt, Homo sapiens
aacuggaaauaaaagau

SEQ ID NO: 40490 - RNA, 22 nt, Homo sapiens
aacugggguggguggggcagug

SEQ ID NO: 40491 - RNA, 18 nt, Homo sapiens
aacuggguuccugcaaug

SEQ ID NO: 40492 - RNA, 17 nt, Homo sapiens
aacuuauuuguacauuu

SEQ ID NO: 40493 - RNA, 23 nt, Homo sapiens
aacuuauuuguacauuuuuuuuu

SEQ ID NO: 40494 - RNA, 15 nt, Homo sapiens
aacuucagcgguuua

SEQ ID NO: 40495 - RNA, 18 nt, Homo sapiens
aacuugaaugugucaggu

SEQ ID NO: 40496 - RNA, 16 nt, Homo sapiens
aacuuuuccaaugaca

SEQ ID NO: 40497 - RNA, 18 nt, Homo sapiens
aacuuuuccaaugacauu

SEQ ID NO: 40498 - RNA, 23 nt, Homo sapiens
aacuuuuuguuuuguuucuuccu

SEQ ID NO: 40499 - RNA, 19 nt, Homo sapiens
aagaaaauggccagugaga

SEQ ID NO: 40500 - RNA, 14 nt, Homo sapiens
aagaaauauuccuu

SEQ ID NO: 40501 - RNA, 23 nt, Homo sapiens
aagaaauguaagggaaacugcca

SEQ ID NO: 40502 - RNA, 14 nt, Homo sapiens
aagaaauucugcaa

SEQ ID NO: 40503 - RNA, 23 nt, Homo sapiens
aagaaauucugcaagcuuuucaa

SEQ ID NO: 40504 - RNA, 18 nt, Homo sapiens
aagaacuaaaauguucua

SEQ ID NO: 40505 - RNA, 14 nt, Homo sapiens
aagaaugauuauga

SEQ ID NO: 40506 - RNA, 12 nt, Homo sapiens
aagacaaaaagc

SEQ ID NO: 40507 - RNA, 13 nt, Homo sapiens
aagacaaaaagcu

SEQ ID NO: 40508 - RNA, 14 nt, Homo sapiens
aagacaaauucugu

SEQ ID NO: 40509 - RNA, 17 nt, Homo sapiens
aagacccaaaaggcaga

SEQ ID NO: 40510 - RNA, 23 nt, Homo sapiens
aagacgugauuuugcuguagaag

SEQ ID NO: 40511 - RNA, 14 nt, Homo sapiens
aagacuauucaaac

SEQ ID NO: 40512 - RNA, 21 nt, Homo sapiens
aagacugaguacguugugcau

SEQ ID NO: 40513 - RNA, 22 nt, Homo sapiens
aagacugaguacguugugcauu

SEQ ID NO: 40514 - RNA, 16 nt, Homo sapiens
aagacugcacaucaaa

SEQ ID NO: 40515 - RNA, 20 nt, Homo sapiens
aagacugcacaucaaaauau

SEQ ID NO: 40516 - RNA, 15 nt, Homo sapiens
aagagaacaagcaaa

SEQ ID NO: 40517 - RNA, 15 nt, Homo sapiens
aagagaacuuccaga

SEQ ID NO: 40518 - RNA, 22 nt, Homo sapiens
aagagaauauuagcuuuacugu

SEQ ID NO: 40519 - RNA, 15 nt, Homo sapiens
aagagaucaagccau

SEQ ID NO: 40520 - RNA, 11 nt, Homo sapiens
aagagcaguag

SEQ ID NO: 40521 - RNA, 11 nt, Homo sapiens
aagagccggag

SEQ ID NO: 40522 - RNA, 13 nt, Homo sapiens
aagagccggagcc

SEQ ID NO: 40523 - RNA, 17 nt, Homo sapiens
aagagccggagccucca

SEQ ID NO: 40524 - RNA, 20 nt, Homo sapiens
aagagccggagccuccagcu

SEQ ID NO: 40525 - RNA, 21 nt, Homo sapiens
aagagccggagccuccagcug

SEQ ID NO: 40526 - RNA, 21 nt, Homo sapiens
aagaggauguguggcauuuuc

SEQ ID NO: 40527 - RNA, 23 nt, Homo sapiens
aagaggauguguggcauuuucac

SEQ ID NO: 40528 - RNA, 23 nt, Homo sapiens
aagaggcagcuugaaacugagau

SEQ ID NO: 40529 - RNA, 20 nt, Homo sapiens
aagauagaagguuugcagau

SEQ ID NO: 40530 - RNA, 15 nt, Homo sapiens
aagauagcagggcau

SEQ ID NO: 40531 - RNA, 20 nt, Homo sapiens
aagauauguaacaacaauua

SEQ ID NO: 40532 - RNA, 16 nt, Homo sapiens
aagaucugcaacuacu

SEQ ID NO: 40533 - RNA, 21 nt, Homo sapiens
aagaucugcaacuacuaucca

SEQ ID NO: 40534 - RNA, 17 nt, Homo sapiens
aagaugaugaugaucuu

SEQ ID NO: 40535 - RNA, 20 nt, Homo sapiens
aagauggcacuuauaaccaa

SEQ ID NO: 40536 - RNA, 22 nt, Homo sapiens
aagauguagaggagaaacugga

SEQ ID NO: 40537 - RNA, 23 nt, Homo sapiens
aagauguagaggagaaacuggaa

SEQ ID NO: 40538 - RNA, 20 nt, Homo sapiens
aagauuguauagugcauguu

SEQ ID NO: 40539 - RNA, 16 nt, Homo sapiens
aagcaaaaugugauau

SEQ ID NO: 40540 - RNA, 21 nt, Homo sapiens
aagcaaagacuaugaggaaua

SEQ ID NO: 40541 - RNA, 19 nt, Homo sapiens
aagcaaauauaaacagcaa

SEQ ID NO: 40542 - RNA, 13 nt, Homo sapiens
aagcaacccaaau

SEQ ID NO: 40543 - RNA, 19 nt, Homo sapiens
aagcaccuuuagaauauua

SEQ ID NO: 40544 - RNA, 15 nt, Homo sapiens
aagcagaacagugau

SEQ ID NO: 40545 - RNA, 16 nt, Homo sapiens
aagcagaacagugauu

SEQ ID NO: 40546 - RNA, 17 nt, Homo sapiens
aagcagaacagugauua

SEQ ID NO: 40547 - RNA, 22 nt, Homo sapiens
aagcagggacuugaacccauau

SEQ ID NO: 40548 - RNA, 17 nt, Homo sapiens
aagcaugugagacuggu

SEQ ID NO: 40549 - RNA, 13 nt, Homo sapiens
aagcauuuagaug

SEQ ID NO: 40550 - RNA, 23 nt, Homo sapiens
aagcauuuuauaaaucgcuuuug

SEQ ID NO: 40551 - RNA, 22 nt, Homo sapiens
aagccagauuuuccugaaaacc

SEQ ID NO: 40552 - RNA, 17 nt, Homo sapiens
aagccucuauugccaug

SEQ ID NO: 40553 - RNA, 19 nt, Homo sapiens
aagccucuauugccaugag

SEQ ID NO: 40554 - RNA, 23 nt, Homo sapiens
aagccugccucaaucaguauuca

SEQ ID NO: 40555 - RNA, 23 nt, Homo sapiens
aagcuagaaaaauuagaugacug

SEQ ID NO: 40556 - RNA, 15 nt, Homo sapiens
aagcugaguguuuca

SEQ ID NO: 40557 - RNA, 14 nt, Homo sapiens
aagcuuauuaaaac

SEQ ID NO: 40558 - RNA, 15 nt, Homo sapiens
aagcuuauuaaaacu

SEQ ID NO: 40559 - RNA, 12 nt, Homo sapiens
aaggaaacuggg

SEQ ID NO: 40560 - RNA, 18 nt, Homo sapiens
aaggaaacuggguuccug

SEQ ID NO: 40561 - RNA, 13 nt, Homo sapiens
aaggaaagauuuu

SEQ ID NO: 40562 - RNA, 14 nt, Homo sapiens
aaggaaagauuuug

SEQ ID NO: 40563 - RNA, 15 nt, Homo sapiens
aaggaaagauuuugu

SEQ ID NO: 40564 - RNA, 13 nt, Homo sapiens
aaggagauuuaca

SEQ ID NO: 40565 - RNA, 17 nt, Homo sapiens
aaggaguccuugcauca

SEQ ID NO: 40566 - RNA, 18 nt, Homo sapiens
aaggaguccuugcaucaa

SEQ ID NO: 40567 - RNA, 20 nt, Homo sapiens
aaggcagcucuaaaugucaa

SEQ ID NO: 40568 - RNA, 22 nt, Homo sapiens
aaggcaggggaauguaugugca

SEQ ID NO: 40569 - RNA, 10 nt, Homo sapiens
aaggcccccg

SEQ ID NO: 40570 - RNA, 18 nt, Homo sapiens
aaggcccccgggccgacg

SEQ ID NO: 40571 - RNA, 19 nt, Homo sapiens
aaggcccccgggccgacgg

SEQ ID NO: 40572 - RNA, 23 nt, Homo sapiens
aaggcccccgggccgacggagcc

SEQ ID NO: 40573 - RNA, 24 nt, Homo sapiens
aaggcccccgggccgacggagccg

SEQ ID NO: 40574 - RNA, 18 nt, Homo sapiens
aaggccugucccugcaga

SEQ ID NO: 40575 - RNA, 22 nt, Homo sapiens
aaggcuuagacccucaugcugc

SEQ ID NO: 40576 - RNA, 15 nt, Homo sapiens
aaggcuuuaucucag

SEQ ID NO: 40577 - RNA, 17 nt, Homo sapiens
aaggcuuuaucucaggg

SEQ ID NO: 40578 - RNA, 15 nt, Homo sapiens
aagggaccucuccau

SEQ ID NO: 40579 - RNA, 18 nt, Homo sapiens
aagggaguuaggcuauuc

SEQ ID NO: 40580 - RNA, 14 nt, Homo sapiens
aagggauggcaaga

SEQ ID NO: 40581 - RNA, 15 nt, Homo sapiens
aaggggcggcggccc

SEQ ID NO: 40582 - RNA, 21 nt, Homo sapiens
aaggggcggcggcccugugcg

SEQ ID NO: 40583 - RNA, 14 nt, Homo sapiens
aagguacuucaaau

SEQ ID NO: 40584 - RNA, 21 nt, Homo sapiens
aagguauuuuaaucaccaagg

SEQ ID NO: 40585 - RNA, 11 nt, Homo sapiens
aaggugaccau

SEQ ID NO: 40586 - RNA, 17 nt, Homo sapiens
aaguaaaaccacagcag

SEQ ID NO: 40587 - RNA, 18 nt, Homo sapiens
aaguaaaaccacagcagu

SEQ ID NO: 40588 - RNA, 17 nt, Homo sapiens
aaguaaacggucucuca

SEQ ID NO: 40589 - RNA, 20 nt, Homo sapiens
aaguaaacggucucucacuu

SEQ ID NO: 40590 - RNA, 14 nt, Homo sapiens
aaguaaugauaacu

SEQ ID NO: 40591 - RNA, 18 nt, Homo sapiens
aaguacauguuaaacuua

SEQ ID NO: 40592 - RNA, 12 nt, Homo sapiens
aaguauccuuca

SEQ ID NO: 40593 - RNA, 17 nt, Homo sapiens
aaguauccuucagccug

SEQ ID NO: 40594 - RNA, 17 nt, Homo sapiens
aaguaugcacuaaucaa

SEQ ID NO: 40595 - RNA, 19 nt, Homo sapiens
aaguaugcacuaaucaaua

SEQ ID NO: 40596 - RNA, 14 nt, Homo sapiens
aaguaugugcauau

SEQ ID NO: 40597 - RNA, 15 nt, Homo sapiens
aagucaaggcuuaga

SEQ ID NO: 40598 - RNA, 19 nt, Homo sapiens
aagucacauuccugaacag

SEQ ID NO: 40599 - RNA, 22 nt, Homo sapiens
aagucagugcccaacuguuaua

SEQ ID NO: 40600 - RNA, 12 nt, Homo sapiens
aaguccaagcau

SEQ ID NO: 40601 - RNA, 18 nt, Homo sapiens
aaguccaagcauaccaac

SEQ ID NO: 40602 - RNA, 16 nt, Homo sapiens
aaguccaagcauuuag

SEQ ID NO: 40603 - RNA, 20 nt, Homo sapiens
aaguccaagcauuuagaugu

SEQ ID NO: 40604 - RNA, 15 nt, Homo sapiens
aagucccagaucaag

SEQ ID NO: 40605 - RNA, 14 nt, Homo sapiens
aagucuuccauaga

SEQ ID NO: 40606 - RNA, 22 nt, Homo sapiens
aagucuuccauagagacuuugu

SEQ ID NO: 40607 - RNA, 13 nt, Homo sapiens
aagugaaacugcu

SEQ ID NO: 40608 - RNA, 17 nt, Homo sapiens
aagugaagacaaugacu

SEQ ID NO: 40609 - RNA, 15 nt, Homo sapiens
aagugauacuaucca

SEQ ID NO: 40610 - RNA, 17 nt, Homo sapiens
aagugauacuauccagu

SEQ ID NO: 40611 - RNA, 23 nt, Homo sapiens
aagugcugggaauuacaggcgug

SEQ ID NO: 40612 - RNA, 12 nt, Homo sapiens
aaguucuaguga

SEQ ID NO: 40613 - RNA, 16 nt, Homo sapiens
aaguucuagugaccga

SEQ ID NO: 40614 - RNA, 17 nt, Homo sapiens
aaguucuagugaccgag

SEQ ID NO: 40615 - RNA, 18 nt, Homo sapiens
aaguucuuaguugcugua

SEQ ID NO: 40616 - RNA, 21 nt, Homo sapiens
aaguugaauuuuacauggcug

SEQ ID NO: 40617 - RNA, 16 nt, Homo sapiens
aaguugcaccaacuuu

SEQ ID NO: 40618 - RNA, 19 nt, Homo sapiens
aaguugcaccaacuuugaa

SEQ ID NO: 40619 - RNA, 17 nt, Homo sapiens
aauaaaaaggugaccau

SEQ ID NO: 40620 - RNA, 20 nt, Homo sapiens
aauaaaacuuuuccaaugac

SEQ ID NO: 40621 - RNA, 23 nt, Homo sapiens
aauaaaagauuguauagugcaug

SEQ ID NO: 40622 - RNA, 13 nt, Homo sapiens
aauaaaagcacuu

SEQ ID NO: 40623 - RNA, 14 nt, Homo sapiens
aauaaaagcacuua

SEQ ID NO: 40624 - RNA, 15 nt, Homo sapiens
aauaaaauacauacu

SEQ ID NO: 40625 - RNA, 16 nt, Homo sapiens
aauaaaaugagcaaaa

SEQ ID NO: 40626 - RNA, 19 nt, Homo sapiens
aauaauacaccagagauaa

SEQ ID NO: 40627 - RNA, 15 nt, Homo sapiens
aauaauuuuuauauu

SEQ ID NO: 40628 - RNA, 20 nt, Homo sapiens
aauacaaaaauuagccgggc

SEQ ID NO: 40629 - RNA, 17 nt, Homo sapiens
aauacacacucaaauca

SEQ ID NO: 40630 - RNA, 13 nt, Homo sapiens
aauacacuguuau

SEQ ID NO: 40631 - RNA, 14 nt, Homo sapiens
aauacacuguuauc

SEQ ID NO: 40632 - RNA, 15 nt, Homo sapiens
aauacacuguuaucu

SEQ ID NO: 40633 - RNA, 22 nt, Homo sapiens
aauacauaaaguaugugcauau

SEQ ID NO: 40634 - RNA, 24 nt, Homo sapiens
aauacauaaaguaugugcauauuu

SEQ ID NO: 40635 - RNA, 20 nt, Homo sapiens
aauacauuauuggacuucca

SEQ ID NO: 40636 - RNA, 20 nt, Homo sapiens
aauacucuuaggaagagaaa

SEQ ID NO: 40637 - RNA, 23 nt, Homo sapiens
aauacucuuaggaagagaaacca

SEQ ID NO: 40638 - RNA, 24 nt, Homo sapiens
aauacucuuaggaagagaaaccag

SEQ ID NO: 40639 - RNA, 16 nt, Homo sapiens
aauacucuuauaucua

SEQ ID NO: 40640 - RNA, 19 nt, Homo sapiens
aauacucuuauaucuauau

SEQ ID NO: 40641 - RNA, 20 nt, Homo sapiens
aauacucuuauaucuauauu

SEQ ID NO: 40642 - RNA, 11 nt, Homo sapiens
aauacugaugu

SEQ ID NO: 40643 - RNA, 20 nt, Homo sapiens
aauacugauguuccuaguga

SEQ ID NO: 40644 - RNA, 22 nt, Homo sapiens
aauacugauguuccuagugaaa

SEQ ID NO: 40645 - RNA, 20 nt, Homo sapiens
aauacuguuugagguuuuua

SEQ ID NO: 40646 - RNA, 21 nt, Homo sapiens
aauacuguuugagguuuuuaa

SEQ ID NO: 40647 - RNA, 14 nt, Homo sapiens
aauacuuugaacac

SEQ ID NO: 40648 - RNA, 19 nt, Homo sapiens
aauagaaggauguacauuu

SEQ ID NO: 40649 - RNA, 21 nt, Homo sapiens
aauagcuaagauauaauuuaa

SEQ ID NO: 40650 - RNA, 21 nt, Homo sapiens
aauaggaaauauuuuaauguu

SEQ ID NO: 40651 - RNA, 18 nt, Homo sapiens
aauagguuuggacaaaau

SEQ ID NO: 40652 - RNA, 22 nt, Homo sapiens
aauaguguuggaaaaugugcaa

SEQ ID NO: 40653 - RNA, 14 nt, Homo sapiens
aauauaaagcaaga

SEQ ID NO: 40654 - RNA, 15 nt, Homo sapiens
aauauaaauuuauca

SEQ ID NO: 40655 - RNA, 20 nt, Homo sapiens
aauauaaauuuaucauuuag

SEQ ID NO: 40656 - RNA, 19 nt, Homo sapiens
aauauaauaugcacacagu

SEQ ID NO: 40657 - RNA, 23 nt, Homo sapiens
aauauagcuuucauaacaucgaa

SEQ ID NO: 40658 - RNA, 19 nt, Homo sapiens
aauaucuccgucaacucau

SEQ ID NO: 40659 - RNA, 14 nt, Homo sapiens
aauaucuuaucuuc

SEQ ID NO: 40660 - RNA, 16 nt, Homo sapiens
aauaucuuaucuuccu

SEQ ID NO: 40661 - RNA, 20 nt, Homo sapiens
aauauguuagagaauuuccu

SEQ ID NO: 40662 - RNA, 13 nt, Homo sapiens
aauauuguugaca

SEQ ID NO: 40663 - RNA, 14 nt, Homo sapiens
aauauuguugacaa

SEQ ID NO: 40664 - RNA, 22 nt, Homo sapiens
aauauuguugacaacugugacu

SEQ ID NO: 40665 - RNA, 23 nt, Homo sapiens
aauauuguugacaacugugacug

SEQ ID NO: 40666 - RNA, 17 nt, Homo sapiens
aauauuugcaagacaua

SEQ ID NO: 40667 - RNA, 22 nt, Homo sapiens
aauauuuuagguguaaaauaau

SEQ ID NO: 40668 - RNA, 17 nt, Homo sapiens
aauauuuuuaugugcaa

SEQ ID NO: 40669 - RNA, 19 nt, Homo sapiens
aauauuuuuaugugcaaua

SEQ ID NO: 40670 - RNA, 20 nt, Homo sapiens
aaucaaauaugcaaagcacu

SEQ ID NO: 40671 - RNA, 19 nt, Homo sapiens
aaucacucauuuauuucca

SEQ ID NO: 40672 - RNA, 15 nt, Homo sapiens
aaucagaucauuuca

SEQ ID NO: 40673 - RNA, 18 nt, Homo sapiens
aaucauaugggauacugc

SEQ ID NO: 40674 - RNA, 22 nt, Homo sapiens
aauccaagaaaauggccaguga

SEQ ID NO: 40675 - RNA, 18 nt, Homo sapiens
aauccagaaauaaugaaa

SEQ ID NO: 40676 - RNA, 14 nt, Homo sapiens
aaucccagcacuuu

SEQ ID NO: 40677 - RNA, 20 nt, Homo sapiens
aaucuaaauggaaccacucu

SEQ ID NO: 40678 - RNA, 12 nt, Homo sapiens
aaucuacacucc

SEQ ID NO: 40679 - RNA, 16 nt, Homo sapiens
aaucucuccauucccg

SEQ ID NO: 40680 - RNA, 18 nt, Homo sapiens
aaucugaggccuccucuc

SEQ ID NO: 40681 - RNA, 23 nt, Homo sapiens
aaucugaggccuccucucucagu

SEQ ID NO: 40682 - RNA, 13 nt, Homo sapiens
aaucugcacugug

SEQ ID NO: 40683 - RNA, 13 nt, Homo sapiens
aaucuggauucau

SEQ ID NO: 40684 - RNA, 21 nt, Homo sapiens
aaucuuuauaguucuacucca

SEQ ID NO: 40685 - RNA, 17 nt, Homo sapiens
aaugaagauacugaaau

SEQ ID NO: 40686 - RNA, 14 nt, Homo sapiens
aaugaaguacucau

SEQ ID NO: 40687 - RNA, 14 nt, Homo sapiens
aaugaaugaaugaa

SEQ ID NO: 40688 - RNA, 13 nt, Homo sapiens
aaugaauggcuaa

SEQ ID NO: 40689 - RNA, 22 nt, Homo sapiens
aaugacacuagcuaauaucaau

SEQ ID NO: 40690 - RNA, 21 nt, Homo sapiens
aaugacuuacuguacaugaaa

SEQ ID NO: 40691 - RNA, 21 nt, Homo sapiens
aaugagaagaaugacuaugca

SEQ ID NO: 40692 - RNA, 17 nt, Homo sapiens
aaugauuucacagugug

SEQ ID NO: 40693 - RNA, 18 nt, Homo sapiens
aaugauuucacagugugu

SEQ ID NO: 40694 - RNA, 15 nt, Homo sapiens
aaugauuucauucaa

SEQ ID NO: 40695 - RNA, 23 nt, Homo sapiens
aaugauuuuacggagauauccca

SEQ ID NO: 40696 - RNA, 19 nt, Homo sapiens
aaugccccugaauuuaaau

SEQ ID NO: 40697 - RNA, 23 nt, Homo sapiens
aaugccccugaauuuaaauagcu

SEQ ID NO: 40698 - RNA, 17 nt, Homo sapiens
aauggaaaguaacucau

SEQ ID NO: 40699 - RNA, 12 nt, Homo sapiens
aauggaauacuc

SEQ ID NO: 40700 - RNA, 17 nt, Homo sapiens
aauggagacaccaccac

SEQ ID NO: 40701 - RNA, 13 nt, Homo sapiens
aauggcaugucag

SEQ ID NO: 40702 - RNA, 14 nt, Homo sapiens
aauggccagugaga

SEQ ID NO: 40703 - RNA, 12 nt, Homo sapiens
aaugggcuacuu

SEQ ID NO: 40704 - RNA, 20 nt, Homo sapiens
aaugguaguuuuacaguguu

SEQ ID NO: 40705 - RNA, 13 nt, Homo sapiens
aaugguauuaaag

SEQ ID NO: 40706 - RNA, 20 nt, Homo sapiens
aaugguuaaaagagguuuuu

SEQ ID NO: 40707 - RNA, 16 nt, Homo sapiens
aaugguuccauucucu

SEQ ID NO: 40708 - RNA, 23 nt, Homo sapiens
aaugugacuuggauucaauuuua

SEQ ID NO: 40709 - RNA, 16 nt, Homo sapiens
aauguguaagacaaaa

SEQ ID NO: 40710 - RNA, 23 nt, Homo sapiens
aaugugucaggugacccugauga

SEQ ID NO: 40711 - RNA, 14 nt, Homo sapiens
aauguguuugagca

SEQ ID NO: 40712 - RNA, 23 nt, Homo sapiens
aauguuaauuaugcaguguuucc

SEQ ID NO: 40713 - RNA, 16 nt, Homo sapiens
aauguucaucaaugaa

SEQ ID NO: 40714 - RNA, 21 nt, Homo sapiens
aauguucuccagucauuaugu

SEQ ID NO: 40715 - RNA, 21 nt, Homo sapiens
aauguugacaugggacauuug

SEQ ID NO: 40716 - RNA, 13 nt, Homo sapiens
aauguuguucucu

SEQ ID NO: 40717 - RNA, 18 nt, Homo sapiens
aauguuuagcagauuuaa

SEQ ID NO: 40718 - RNA, 13 nt, Homo sapiens
aauguuucaaaca

SEQ ID NO: 40719 - RNA, 14 nt, Homo sapiens
aauguuucaaacau

SEQ ID NO: 40720 - RNA, 14 nt, Homo sapiens
aauuaaagcuaaag

SEQ ID NO: 40721 - RNA, 22 nt, Homo sapiens
aauuaaggguaugauuaacucu

SEQ ID NO: 40722 - RNA, 13 nt, Homo sapiens
aauuagaugacug

SEQ ID NO: 40723 - RNA, 12 nt, Homo sapiens
aauuagccgggc

SEQ ID NO: 40724 - RNA, 13 nt, Homo sapiens
aauuauauaguua

SEQ ID NO: 40725 - RNA, 16 nt, Homo sapiens
aauuauauauacuaua

SEQ ID NO: 40726 - RNA, 17 nt, Homo sapiens
aauuauauauacuauau

SEQ ID NO: 40727 - RNA, 21 nt, Homo sapiens
aauuauauauacuauauuuuu

SEQ ID NO: 40728 - RNA, 20 nt, Homo sapiens
aauuauauuuugaacaacuc

SEQ ID NO: 40729 - RNA, 16 nt, Homo sapiens
aauuauugauguuuuc

SEQ ID NO: 40730 - RNA, 19 nt, Homo sapiens
aauuauugauguuuucaua

SEQ ID NO: 40731 - RNA, 20 nt, Homo sapiens
aauuauugauguuuucauag

SEQ ID NO: 40732 - RNA, 14 nt, Homo sapiens
aauuauuucacuuu

SEQ ID NO: 40733 - RNA, 16 nt, Homo sapiens
aauuauuucacuuuag

SEQ ID NO: 40734 - RNA, 13 nt, Homo sapiens
aauucacuccacu

SEQ ID NO: 40735 - RNA, 17 nt, Homo sapiens
aauucacuccacuugga

SEQ ID NO: 40736 - RNA, 12 nt, Homo sapiens
aauucauguuuc

SEQ ID NO: 40737 - RNA, 15 nt, Homo sapiens
aauucauuccauuug

SEQ ID NO: 40738 - RNA, 16 nt, Homo sapiens
aauuccaauacauuau

SEQ ID NO: 40739 - RNA, 13 nt, Homo sapiens
aauuccucuggga

SEQ ID NO: 40740 - RNA, 14 nt, Homo sapiens
aauuccucugggaa

SEQ ID NO: 40741 - RNA, 15 nt, Homo sapiens
aauucgcugcaaccu

SEQ ID NO: 40742 - RNA, 19 nt, Homo sapiens
aauucuauuacgugcaaua

SEQ ID NO: 40743 - RNA, 21 nt, Homo sapiens
aauucuauuacgugcaauacu

SEQ ID NO: 40744 - RNA, 15 nt, Homo sapiens
aauucugcaagcuuu

SEQ ID NO: 40745 - RNA, 13 nt, Homo sapiens
aauugacacuuaa

SEQ ID NO: 40746 - RNA, 12 nt, Homo sapiens
aauugcuaucgc

SEQ ID NO: 40747 - RNA, 17 nt, Homo sapiens
aauuuaaauagcuuuuu

SEQ ID NO: 40748 - RNA, 12 nt, Homo sapiens
aauuuacuuugu

SEQ ID NO: 40749 - RNA, 18 nt, Homo sapiens
aauuuauucaauuccucu

SEQ ID NO: 40750 - RNA, 16 nt, Homo sapiens
aauuucauaccuauca

SEQ ID NO: 40751 - RNA, 20 nt, Homo sapiens
aauuucauaccuaucaucuu

SEQ ID NO: 40752 - RNA, 13 nt, Homo sapiens
aauuuccuuacuc

SEQ ID NO: 40753 - RNA, 19 nt, Homo sapiens
aauuucuaggacugaauua

SEQ ID NO: 40754 - RNA, 18 nt, Homo sapiens
aauuugauaugugaacag

SEQ ID NO: 40755 - RNA, 21 nt, Homo sapiens
aauuugguucuaggccgggcg

SEQ ID NO: 40756 - RNA, 16 nt, Homo sapiens
aauuugguuuucacau

SEQ ID NO: 40757 - RNA, 22 nt, Homo sapiens
aauuuucaaaaucaaauuccag

SEQ ID NO: 40758 - RNA, 17 nt, Homo sapiens
aauuuucccucuucacu

SEQ ID NO: 40759 - RNA, 13 nt, Homo sapiens
aauuuucuuccaa

SEQ ID NO: 40760 - RNA, 15 nt, Homo sapiens
aauuuugugaagcaa

SEQ ID NO: 40761 - RNA, 16 nt, Homo sapiens
aauuuugugaagcaaa

SEQ ID NO: 40762 - RNA, 18 nt, Homo sapiens
aauuuugugaagcaaaau

SEQ ID NO: 40763 - RNA, 16 nt, Homo sapiens
aauuuuuucucuagga

SEQ ID NO: 40764 - RNA, 14 nt, Homo sapiens
acaaaaaaagcauu

SEQ ID NO: 40765 - RNA, 19 nt, Homo sapiens
acaaaaauuagccgggcau

SEQ ID NO: 40766 - RNA, 13 nt, Homo sapiens
acaaaauauagcu

SEQ ID NO: 40767 - RNA, 19 nt, Homo sapiens
acaaaauggaauacucuua

SEQ ID NO: 40768 - RNA, 16 nt, Homo sapiens
acaaagaagacaacau

SEQ ID NO: 40769 - RNA, 22 nt, Homo sapiens
acaaaggggcuuaauuauugau

SEQ ID NO: 40770 - RNA, 18 nt, Homo sapiens
acaacauuaaaacaauau

SEQ ID NO: 40771 - RNA, 13 nt, Homo sapiens
acaaccuguccca

SEQ ID NO: 40772 - RNA, 17 nt, Homo sapiens
acaacucgaaucacuca

SEQ ID NO: 40773 - RNA, 18 nt, Homo sapiens
acaacuugaauaauacac

SEQ ID NO: 40774 - RNA, 22 nt, Homo sapiens
acaagacugcacaucaaaauau

SEQ ID NO: 40775 - RNA, 20 nt, Homo sapiens
acaaggaugaauuaaguuuu

SEQ ID NO: 40776 - RNA, 19 nt, Homo sapiens
acaaggcuuuaucucaggg

SEQ ID NO: 40777 - RNA, 23 nt, Homo sapiens
acaagguucuucccuuuuacaua

SEQ ID NO: 40778 - RNA, 16 nt, Homo sapiens
acaagucagucauuca

SEQ ID NO: 40779 - RNA, 18 nt, Homo sapiens
acaagugaaaaacaucca

SEQ ID NO: 40780 - RNA, 14 nt, Homo sapiens
acaauacaucccuu

SEQ ID NO: 40781 - RNA, 15 nt, Homo sapiens
acaaugaacacuuau

SEQ ID NO: 40782 - RNA, 17 nt, Homo sapiens
acaaugacuuacuguac

SEQ ID NO: 40783 - RNA, 19 nt, Homo sapiens
acaaugacuuguacucuga

SEQ ID NO: 40784 - RNA, 11 nt, Homo sapiens
acaaugcauuc

SEQ ID NO: 40785 - RNA, 21 nt, Homo sapiens
acaauuauuuuuacaguucuc

SEQ ID NO: 40786 - RNA, 23 nt, Homo sapiens
acacacaugaaguccaagcauuu

SEQ ID NO: 40787 - RNA, 17 nt, Homo sapiens
acacaggcuccaaacug

SEQ ID NO: 40788 - RNA, 14 nt, Homo sapiens
acacagugucuggc

SEQ ID NO: 40789 - RNA, 22 nt, Homo sapiens
acacaugauccugcaauuccac

SEQ ID NO: 40790 - RNA, 18 nt, Homo sapiens
acacauuuuucuuaggga

SEQ ID NO: 40791 - RNA, 20 nt, Homo sapiens
acacauuuuuuaaaugcacc

SEQ ID NO: 40792 - RNA, 21 nt, Homo sapiens
acacauuuuuuaaaugcaccu

SEQ ID NO: 40793 - RNA, 12 nt, Homo sapiens
acaccaccaccc

SEQ ID NO: 40794 - RNA, 22 nt, Homo sapiens
acaccagagauaauaugagaau

SEQ ID NO: 40795 - RNA, 20 nt, Homo sapiens
acaccaggauuuaaguuuca

SEQ ID NO: 40796 - RNA, 23 nt, Homo sapiens
acaccgaguggcccuucauguac

SEQ ID NO: 40797 - RNA, 13 nt, Homo sapiens
acaccucagcugc

SEQ ID NO: 40798 - RNA, 16 nt, Homo sapiens
acaccucagcugccuc

SEQ ID NO: 40799 - RNA, 19 nt, Homo sapiens
acacuaaaaaggcauguaa

SEQ ID NO: 40800 - RNA, 14 nt, Homo sapiens
acacuaaaacaccu

SEQ ID NO: 40801 - RNA, 17 nt, Homo sapiens
acacucaaaucaagaaa

SEQ ID NO: 40802 - RNA, 20 nt, Homo sapiens
acacugcauguuugugauug

SEQ ID NO: 40803 - RNA, 11 nt, Homo sapiens
acacuguccau

SEQ ID NO: 40804 - RNA, 18 nt, Homo sapiens
acacuguuaucuucacuu

SEQ ID NO: 40805 - RNA, 20 nt, Homo sapiens
acacuguuaucuucacuuuu

SEQ ID NO: 40806 - RNA, 15 nt, Homo sapiens
acacuuauaagugaa

SEQ ID NO: 40807 - RNA, 11 nt, Homo sapiens
acagaaaaguu

SEQ ID NO: 40808 - RNA, 12 nt, Homo sapiens
acagaacuugaa

SEQ ID NO: 40809 - RNA, 15 nt, Homo sapiens
acagaagagugacau

SEQ ID NO: 40810 - RNA, 16 nt, Homo sapiens
acagagaaaagacaua

SEQ ID NO: 40811 - RNA, 20 nt, Homo sapiens
acagagcaagacucugucuc

SEQ ID NO: 40812 - RNA, 14 nt, Homo sapiens
acagaguuguuaca

SEQ ID NO: 40813 - RNA, 16 nt, Homo sapiens
acagaguuguuacauu

SEQ ID NO: 40814 - RNA, 18 nt, Homo sapiens
acagcaacuuguguuccu

SEQ ID NO: 40815 - RNA, 20 nt, Homo sapiens
acagcaagggugaugggaaa

SEQ ID NO: 40816 - RNA, 16 nt, Homo sapiens
acagcacuuacaauuu

SEQ ID NO: 40817 - RNA, 16 nt, Homo sapiens
acagcccaaggguggg

SEQ ID NO: 40818 - RNA, 18 nt, Homo sapiens
acagcccuucuuuccaca

SEQ ID NO: 40819 - RNA, 17 nt, Homo sapiens
acagcuacuugggaggc

SEQ ID NO: 40820 - RNA, 18 nt, Homo sapiens
acagcuacuugggaggcu

SEQ ID NO: 40821 - RNA, 20 nt, Homo sapiens
acagcuacuugggaggcuga

SEQ ID NO: 40822 - RNA, 19 nt, Homo sapiens
acagcuccaagaauuucua

SEQ ID NO: 40823 - RNA, 12 nt, Homo sapiens
acaggaaccaca

SEQ ID NO: 40824 - RNA, 22 nt, Homo sapiens
acaggaaguagaggaggccacg

SEQ ID NO: 40825 - RNA, 17 nt, Homo sapiens
acaggacagcccuucuu

SEQ ID NO: 40826 - RNA, 21 nt, Homo sapiens
acaggacagcccuucuuucca

SEQ ID NO: 40827 - RNA, 19 nt, Homo sapiens
acaggaggggaaggcaaca

SEQ ID NO: 40828 - RNA, 15 nt, Homo sapiens
acaggauauucucac

SEQ ID NO: 40829 - RNA, 14 nt, Homo sapiens
acaggcaaauuccu

SEQ ID NO: 40830 - RNA, 16 nt, Homo sapiens
acagggaaagggucuc

SEQ ID NO: 40831 - RNA, 16 nt, Homo sapiens
acaguauggcagcuuu

SEQ ID NO: 40832 - RNA, 22 nt, Homo sapiens
acaguauggcagcuuuccucaa

SEQ ID NO: 40833 - RNA, 22 nt, Homo sapiens
acagucacauuccaagccucau

SEQ ID NO: 40834 - RNA, 22 nt, Homo sapiens
acagucuuguauuaaguuguua

SEQ ID NO: 40835 - RNA, 19 nt, Homo sapiens
acagugagacucugucuca

SEQ ID NO: 40836 - RNA, 14 nt, Homo sapiens
acagugucuggcac

SEQ ID NO: 40837 - RNA, 16 nt, Homo sapiens
acagugucuggcacuu

SEQ ID NO: 40838 - RNA, 15 nt, Homo sapiens
acaguguuucuggcu

SEQ ID NO: 40839 - RNA, 17 nt, Homo sapiens
acaguuaccucugccuc

SEQ ID NO: 40840 - RNA, 15 nt, Homo sapiens
acaguuccugagacc

SEQ ID NO: 40841 - RNA, 22 nt, Homo sapiens
acaguuuucugcuuuaauuuca

SEQ ID NO: 40842 - RNA, 20 nt, Homo sapiens
acaguuuugguugcuuuaau

SEQ ID NO: 40843 - RNA, 18 nt, Homo sapiens
acaguuuuuauugcuugu

SEQ ID NO: 40844 - RNA, 19 nt, Homo sapiens
acaguuuuuauugcuuguu

SEQ ID NO: 40845 - RNA, 14 nt, Homo sapiens
acauaacauaagcu

SEQ ID NO: 40846 - RNA, 18 nt, Homo sapiens
acauaaggaaacuggguu

SEQ ID NO: 40847 - RNA, 19 nt, Homo sapiens
acauaaggaaacuggguuc

SEQ ID NO: 40848 - RNA, 15 nt, Homo sapiens
acauagcaucucagg

SEQ ID NO: 40849 - RNA, 17 nt, Homo sapiens
acauaucacaugucagc

SEQ ID NO: 40850 - RNA, 17 nt, Homo sapiens
acauauccuuagcccau

SEQ ID NO: 40851 - RNA, 21 nt, Homo sapiens
acauauugauuuccguuaaaa

SEQ ID NO: 40852 - RNA, 16 nt, Homo sapiens
acaucaguuacucuga

SEQ ID NO: 40853 - RNA, 18 nt, Homo sapiens
acauccagauagguuacc

SEQ ID NO: 40854 - RNA, 19 nt, Homo sapiens
acauccagauagguuacca

SEQ ID NO: 40855 - RNA, 14 nt, Homo sapiens
acaucucugcaauc

SEQ ID NO: 40856 - RNA, 11 nt, Homo sapiens
acaucuuucac

SEQ ID NO: 40857 - RNA, 14 nt, Homo sapiens
acaucuuucacauu

SEQ ID NO: 40858 - RNA, 20 nt, Homo sapiens
acaugaaguccaagcauuua

SEQ ID NO: 40859 - RNA, 15 nt, Homo sapiens
acaugagagacagca

SEQ ID NO: 40860 - RNA, 19 nt, Homo sapiens
acaugagccuuuguugcua

SEQ ID NO: 40861 - RNA, 14 nt, Homo sapiens
acaugauccugcaa

SEQ ID NO: 40862 - RNA, 20 nt, Homo sapiens
acaugauccugcaauuccac

SEQ ID NO: 40863 - RNA, 18 nt, Homo sapiens
acaugccagccacuguga

SEQ ID NO: 40864 - RNA, 14 nt, Homo sapiens
acauggcuggagcu

SEQ ID NO: 40865 - RNA, 21 nt, Homo sapiens
acauggcuggagcuagaauuu

SEQ ID NO: 40866 - RNA, 16 nt, Homo sapiens
acauguauguaaauag

SEQ ID NO: 40867 - RNA, 14 nt, Homo sapiens
acauucuguuaauc

SEQ ID NO: 40868 - RNA, 14 nt, Homo sapiens
acauuggcuauuua

SEQ ID NO: 40869 - RNA, 20 nt, Homo sapiens
acauuguuugucugucuuca

SEQ ID NO: 40870 - RNA, 17 nt, Homo sapiens
acauuucucauguugaa

SEQ ID NO: 40871 - RNA, 17 nt, Homo sapiens
acauuuuaugucuuucu

SEQ ID NO: 40872 - RNA, 21 nt, Homo sapiens
acauuuuucuuagggaaggau

SEQ ID NO: 40873 - RNA, 19 nt, Homo sapiens
accaaaaaucucaauauuu

SEQ ID NO: 40874 - RNA, 16 nt, Homo sapiens
accaaauugagcuagg

SEQ ID NO: 40875 - RNA, 13 nt, Homo sapiens
accaaauuuguau

SEQ ID NO: 40876 - RNA, 21 nt, Homo sapiens
accaaggcccccgggccgacg

SEQ ID NO: 40877 - RNA, 22 nt, Homo sapiens
accaaggcccccgggccgacgg

SEQ ID NO: 40878 - RNA, 12 nt, Homo sapiens
accaaggcugau

SEQ ID NO: 40879 - RNA, 20 nt, Homo sapiens
accaaggcugauuaaaccaa

SEQ ID NO: 40880 - RNA, 13 nt, Homo sapiens
accaauauuguac

SEQ ID NO: 40881 - RNA, 16 nt, Homo sapiens
accaauauuguacagu

SEQ ID NO: 40882 - RNA, 18 nt, Homo sapiens
accaccacccuugccaug

SEQ ID NO: 40883 - RNA, 15 nt, Homo sapiens
accacccuugccaug

SEQ ID NO: 40884 - RNA, 17 nt, Homo sapiens
accacccuugccaugga

SEQ ID NO: 40885 - RNA, 14 nt, Homo sapiens
accagacucuauaa

SEQ ID NO: 40886 - RNA, 15 nt, Homo sapiens
accagacucuauaaa

SEQ ID NO: 40887 - RNA, 13 nt, Homo sapiens
accagcagaaaug

SEQ ID NO: 40888 - RNA, 12 nt, Homo sapiens
accagccugguc

SEQ ID NO: 40889 - RNA, 22 nt, Homo sapiens
accagccuggucaacaugguga

SEQ ID NO: 40890 - RNA, 16 nt, Homo sapiens
accaggcacccccaga

SEQ ID NO: 40891 - RNA, 12 nt, Homo sapiens
accagggacuga

SEQ ID NO: 40892 - RNA, 11 nt, Homo sapiens
accagggagcc

SEQ ID NO: 40893 - RNA, 15 nt, Homo sapiens
accagggccuggcug

SEQ ID NO: 40894 - RNA, 14 nt, Homo sapiens
accaguauucccuu

SEQ ID NO: 40895 - RNA, 18 nt, Homo sapiens
accauaaauuuaaaugga

SEQ ID NO: 40896 - RNA, 20 nt, Homo sapiens
accaucaauuuuaguuguca

SEQ ID NO: 40897 - RNA, 11 nt, Homo sapiens
accaucccggc

SEQ ID NO: 40898 - RNA, 15 nt, Homo sapiens
accaucccggccggc

SEQ ID NO: 40899 - RNA, 17 nt, Homo sapiens
accaucccggccggcgc

SEQ ID NO: 40900 - RNA, 19 nt, Homo sapiens
accaucccggccggcgcgc

SEQ ID NO: 40901 - RNA, 21 nt, Homo sapiens
accaucccggccggcgcgcuc

SEQ ID NO: 40902 - RNA, 18 nt, Homo sapiens
accauuuuugaaaccaaa

SEQ ID NO: 40903 - RNA, 14 nt, Homo sapiens
acccaaaguaucag

SEQ ID NO: 40904 - RNA, 23 nt, Homo sapiens
acccaaaguaucaggacgagaau

SEQ ID NO: 40905 - RNA, 23 nt, Homo sapiens
acccaaguuaguucaauccugau

SEQ ID NO: 40906 - RNA, 17 nt, Homo sapiens
acccacaagaaaugaaa

SEQ ID NO: 40907 - RNA, 24 nt, Homo sapiens
accccagggcuugugugcacauau

SEQ ID NO: 40908 - RNA, 10 nt, Homo sapiens
acccccagaa

SEQ ID NO: 40909 - RNA, 20 nt, Homo sapiens
accccggaagccaaaccucu

SEQ ID NO: 40910 - RNA, 13 nt, Homo sapiens
acccggccugauu

SEQ ID NO: 40911 - RNA, 12 nt, Homo sapiens
acccgggaggca

SEQ ID NO: 40912 - RNA, 11 nt, Homo sapiens
acccucugggu

SEQ ID NO: 40913 - RNA, 13 nt, Homo sapiens
acccucugggucu

SEQ ID NO: 40914 - RNA, 13 nt, Homo sapiens
accgcaaugugac

SEQ ID NO: 40915 - RNA, 21 nt, Homo sapiens
accgcagggugaacugcagcg

SEQ ID NO: 40916 - RNA, 16 nt, Homo sapiens
accgcuguacgcgagc

SEQ ID NO: 40917 - RNA, 17 nt, Homo sapiens
accgcuguacgcgagcg

SEQ ID NO: 40918 - RNA, 22 nt, Homo sapiens
accgcuguacgcgagcgcgcgc

SEQ ID NO: 40919 - RNA, 18 nt, Homo sapiens
accguuugugauugccau

SEQ ID NO: 40920 - RNA, 16 nt, Homo sapiens
accuaaauuugguucu

SEQ ID NO: 40921 - RNA, 13 nt, Homo sapiens
accuacaguguac

SEQ ID NO: 40922 - RNA, 14 nt, Homo sapiens
accuacaguguaca

SEQ ID NO: 40923 - RNA, 19 nt, Homo sapiens
accuacaugagguacugag

SEQ ID NO: 40924 - RNA, 13 nt, Homo sapiens
accucauggaauu

SEQ ID NO: 40925 - RNA, 12 nt, Homo sapiens
accucauuauca

SEQ ID NO: 40926 - RNA, 16 nt, Homo sapiens
accuccaccuucuggg

SEQ ID NO: 40927 - RNA, 23 nt, Homo sapiens
accucccauucacagauaccucu

SEQ ID NO: 40928 - RNA, 13 nt, Homo sapiens
accuccuccuuca

SEQ ID NO: 40929 - RNA, 12 nt, Homo sapiens
accuccugccuc

SEQ ID NO: 40930 - RNA, 11 nt, Homo sapiens
accucuaaauu

SEQ ID NO: 40931 - RNA, 14 nt, Homo sapiens
accucuccagccuc

SEQ ID NO: 40932 - RNA, 19 nt, Homo sapiens
accucucccaacuauaaaa

SEQ ID NO: 40933 - RNA, 20 nt, Homo sapiens
accucucuuguagcucucug

SEQ ID NO: 40934 - RNA, 18 nt, Homo sapiens
accucugccucagaaaac

SEQ ID NO: 40935 - RNA, 12 nt, Homo sapiens
accucugcuauu

SEQ ID NO: 40936 - RNA, 17 nt, Homo sapiens
accugacagcccaaggg

SEQ ID NO: 40937 - RNA, 10 nt, Homo sapiens
accugagccc

SEQ ID NO: 40938 - RNA, 10 nt, Homo sapiens
accugcaggc

SEQ ID NO: 40939 - RNA, 22 nt, Homo sapiens
accugcuguuuccuagcgcagc

SEQ ID NO: 40940 - RNA, 23 nt, Homo sapiens
accugcuguuuccuagcgcagcc

SEQ ID NO: 40941 - RNA, 24 nt, Homo sapiens
accugcuguuuccuagcgcagcca

SEQ ID NO: 40942 - RNA, 17 nt, Homo sapiens
accuguaaucccagcua

SEQ ID NO: 40943 - RNA, 14 nt, Homo sapiens
accuguccccgaaa

SEQ ID NO: 40944 - RNA, 15 nt, Homo sapiens
accuguucgcgcgcc

SEQ ID NO: 40945 - RNA, 16 nt, Homo sapiens
accuguucgcgcgccu

SEQ ID NO: 40946 - RNA, 21 nt, Homo sapiens
accuguugauagcaagugaau

SEQ ID NO: 40947 - RNA, 12 nt, Homo sapiens
accuuacuucuu

SEQ ID NO: 40948 - RNA, 15 nt, Homo sapiens
accuuacuucuucuc

SEQ ID NO: 40949 - RNA, 17 nt, Homo sapiens
accuuacuucuucucau

SEQ ID NO: 40950 - RNA, 22 nt, Homo sapiens
accuuacuucuucucauacuau

SEQ ID NO: 40951 - RNA, 13 nt, Homo sapiens
accuucccagcua

SEQ ID NO: 40952 - RNA, 20 nt, Homo sapiens
accuucccagcuagaauuca

SEQ ID NO: 40953 - RNA, 18 nt, Homo sapiens
accuucucaccugugaga

SEQ ID NO: 40954 - RNA, 22 nt, Homo sapiens
accuuuguauucucuccuguac

SEQ ID NO: 40955 - RNA, 13 nt, Homo sapiens
accuuuguuccca

SEQ ID NO: 40956 - RNA, 18 nt, Homo sapiens
accuuuuuuauacauaaa

SEQ ID NO: 40957 - RNA, 22 nt, Homo sapiens
acgagcaggcuacugucagcuc

SEQ ID NO: 40958 - RNA, 22 nt, Homo sapiens
acgaugggcuuucccaacagcu

SEQ ID NO: 40959 - RNA, 17 nt, Homo sapiens
acgccuguaaucccagc

SEQ ID NO: 40960 - RNA, 21 nt, Homo sapiens
acgccuguaaucccagcacuu

SEQ ID NO: 40961 - RNA, 14 nt, Homo sapiens
acgcgagcgcgcgc

SEQ ID NO: 40962 - RNA, 15 nt, Homo sapiens
acgcgagcgcgcgcg

SEQ ID NO: 40963 - RNA, 12 nt, Homo sapiens
acgcgcgcuccg

SEQ ID NO: 40964 - RNA, 18 nt, Homo sapiens
acgcgcgcuccgcgcagc

SEQ ID NO: 40965 - RNA, 16 nt, Homo sapiens
acgcucugggucgccg

SEQ ID NO: 40966 - RNA, 18 nt, Homo sapiens
acgcucugggucgccggc

SEQ ID NO: 40967 - RNA, 12 nt, Homo sapiens
acgcugcugccg

SEQ ID NO: 40968 - RNA, 13 nt, Homo sapiens
acgcugcugccgu

SEQ ID NO: 40969 - RNA, 13 nt, Homo sapiens
acggagccgggaa

SEQ ID NO: 40970 - RNA, 17 nt, Homo sapiens
acggcagggaaauguau

SEQ ID NO: 40971 - RNA, 12 nt, Homo sapiens
acggcuccggac

SEQ ID NO: 40972 - RNA, 14 nt, Homo sapiens
acggcuccggacgc

SEQ ID NO: 40973 - RNA, 15 nt, Homo sapiens
acggcuccggacgcu

SEQ ID NO: 40974 - RNA, 21 nt, Homo sapiens
acggcuccggacgcugcugcc

SEQ ID NO: 40975 - RNA, 14 nt, Homo sapiens
acggggugaaaccc

SEQ ID NO: 40976 - RNA, 15 nt, Homo sapiens
acgggguuugccaug

SEQ ID NO: 40977 - RNA, 23 nt, Homo sapiens
acgggguuugccaugcuggccag

SEQ ID NO: 40978 - RNA, 18 nt, Homo sapiens
acggucacuuuacugucc

SEQ ID NO: 40979 - RNA, 22 nt, Homo sapiens
acggucacuuuacuguccccau

SEQ ID NO: 40980 - RNA, 20 nt, Homo sapiens
acguauugcauuuaauuuau

SEQ ID NO: 40981 - RNA, 21 nt, Homo sapiens
acguauugcauuuaauuuauu

SEQ ID NO: 40982 - RNA, 20 nt, Homo sapiens
acgucccuagcccuuacguc

SEQ ID NO: 40983 - RNA, 13 nt, Homo sapiens
acgucuuaaauau

SEQ ID NO: 40984 - RNA, 18 nt, Homo sapiens
acgugacuggccugcugg

SEQ ID NO: 40985 - RNA, 19 nt, Homo sapiens
acgugacuggccugcugga

SEQ ID NO: 40986 - RNA, 21 nt, Homo sapiens
acgugacuggccugcuggaug

SEQ ID NO: 40987 - RNA, 18 nt, Homo sapiens
acgugauuuugcuguaga

SEQ ID NO: 40988 - RNA, 16 nt, Homo sapiens
acguguauauuuuuua

SEQ ID NO: 40989 - RNA, 13 nt, Homo sapiens
acguugugcauuu

SEQ ID NO: 40990 - RNA, 14 nt, Homo sapiens
acuaaaaaggcaug

SEQ ID NO: 40991 - RNA, 16 nt, Homo sapiens
acuaaaaauacaaaaa

SEQ ID NO: 40992 - RNA, 17 nt, Homo sapiens
acuaaacauguauguaa

SEQ ID NO: 40993 - RNA, 12 nt, Homo sapiens
acuaaacuuuca

SEQ ID NO: 40994 - RNA, 18 nt, Homo sapiens
acuaaauugacacuuaaa

SEQ ID NO: 40995 - RNA, 15 nt, Homo sapiens
acuaauaaaauacau

SEQ ID NO: 40996 - RNA, 16 nt, Homo sapiens
acuaauaaaauacaua

SEQ ID NO: 40997 - RNA, 17 nt, Homo sapiens
acuaaucaauacuuuga

SEQ ID NO: 40998 - RNA, 19 nt, Homo sapiens
acuaauguguaagacaaaa

SEQ ID NO: 40999 - RNA, 23 nt, Homo sapiens
acuaauuaggcaaggcuauguga

SEQ ID NO: 41000 - RNA, 13 nt, Homo sapiens
acuagauacugaa

SEQ ID NO: 41001 - RNA, 18 nt, Homo sapiens
acuagauacugaauguaa

SEQ ID NO: 41002 - RNA, 19 nt, Homo sapiens
acuagauacugaauguaaa

SEQ ID NO: 41003 - RNA, 13 nt, Homo sapiens
acuaggugcugca

SEQ ID NO: 41004 - RNA, 16 nt, Homo sapiens
acuaguuguaauuuuu

SEQ ID NO: 41005 - RNA, 11 nt, Homo sapiens
acuauaaaacu

SEQ ID NO: 41006 - RNA, 16 nt, Homo sapiens
acuauccaacuuauau

SEQ ID NO: 41007 - RNA, 16 nt, Homo sapiens
acuauccaguuacugc

SEQ ID NO: 41008 - RNA, 17 nt, Homo sapiens
acuauuauagaauggaa

SEQ ID NO: 41009 - RNA, 20 nt, Homo sapiens
acucaucaaucaaauaagua

SEQ ID NO: 41010 - RNA, 21 nt, Homo sapiens
acucaucaaucaaauaaguau

SEQ ID NO: 41011 - RNA, 14 nt, Homo sapiens
acucauccauuaau

SEQ ID NO: 41012 - RNA, 21 nt, Homo sapiens
acucauccauuaauguagaua

SEQ ID NO: 41013 - RNA, 14 nt, Homo sapiens
acucauuaaaugga

SEQ ID NO: 41014 - RNA, 22 nt, Homo sapiens
acucauuaaauggaaguaaaug

SEQ ID NO: 41015 - RNA, 18 nt, Homo sapiens
acucauugcaaccuccac

SEQ ID NO: 41016 - RNA, 15 nt, Homo sapiens
acucauuuauuucca

SEQ ID NO: 41017 - RNA, 23 nt, Homo sapiens
acucauuuuuguuuucauuaucu

SEQ ID NO: 41018 - RNA, 15 nt, Homo sapiens
acuccaaacugacuc

SEQ ID NO: 41019 - RNA, 17 nt, Homo sapiens
acuccaaacugacucuu

SEQ ID NO: 41020 - RNA, 12 nt, Homo sapiens
acuccacauccu

SEQ ID NO: 41021 - RNA, 13 nt, Homo sapiens
acuccacuuggac

SEQ ID NO: 41022 - RNA, 19 nt, Homo sapiens
acuccacuuggacaugggc

SEQ ID NO: 41023 - RNA, 23 nt, Homo sapiens
acuccagccugagcgacagugag

SEQ ID NO: 41024 - RNA, 16 nt, Homo sapiens
acuccuaguaauuuaa

SEQ ID NO: 41025 - RNA, 20 nt, Homo sapiens
acucuacagccaggcggcug

SEQ ID NO: 41026 - RNA, 14 nt, Homo sapiens
acucuaccugcaca

SEQ ID NO: 41027 - RNA, 23 nt, Homo sapiens
acucuauaaauaaaaccugacag

SEQ ID NO: 41028 - RNA, 23 nt, Homo sapiens
acucuauguucuaagaagugaaa

SEQ ID NO: 41029 - RNA, 13 nt, Homo sapiens
acucuuaagaaga

SEQ ID NO: 41030 - RNA, 19 nt, Homo sapiens
acucuuaggaagagaaacc

SEQ ID NO: 41031 - RNA, 15 nt, Homo sapiens
acucuuauaucuaua

SEQ ID NO: 41032 - RNA, 20 nt, Homo sapiens
acucuuauaucuauauuuua

SEQ ID NO: 41033 - RNA, 16 nt, Homo sapiens
acucuugauuguggga

SEQ ID NO: 41034 - RNA, 14 nt, Homo sapiens
acugaaaucauacu

SEQ ID NO: 41035 - RNA, 18 nt, Homo sapiens
acugaauguaaacaaagg

SEQ ID NO: 41036 - RNA, 16 nt, Homo sapiens
acugaauuaugaaacu

SEQ ID NO: 41037 - RNA, 12 nt, Homo sapiens
acugacucuuaa

SEQ ID NO: 41038 - RNA, 19 nt, Homo sapiens
acugagaugugaacacauc

SEQ ID NO: 41039 - RNA, 22 nt, Homo sapiens
acugaguacguugugcauuugg

SEQ ID NO: 41040 - RNA, 18 nt, Homo sapiens
acugauaugggucuugau

SEQ ID NO: 41041 - RNA, 15 nt, Homo sapiens
acugcacaucaaaau

SEQ ID NO: 41042 - RNA, 16 nt, Homo sapiens
acugcauacaaucuga

SEQ ID NO: 41043 - RNA, 17 nt, Homo sapiens
acugcauuauauuuauu

SEQ ID NO: 41044 - RNA, 18 nt, Homo sapiens
acugcauuauauuuauua

SEQ ID NO: 41045 - RNA, 17 nt, Homo sapiens
acugccaucauuuacuu

SEQ ID NO: 41046 - RNA, 17 nt, Homo sapiens
acugccgguuugaaaau

SEQ ID NO: 41047 - RNA, 15 nt, Homo sapiens
acugccuaucagcau

SEQ ID NO: 41048 - RNA, 17 nt, Homo sapiens
acugccuucucaacucc

SEQ ID NO: 41049 - RNA, 13 nt, Homo sapiens
acugcuuaacuuc

SEQ ID NO: 41050 - RNA, 13 nt, Homo sapiens
acuggccugcugg

SEQ ID NO: 41051 - RNA, 16 nt, Homo sapiens
acuggccugcuggaug

SEQ ID NO: 41052 - RNA, 23 nt, Homo sapiens
acuggcucccuggaagagaucaa

SEQ ID NO: 41053 - RNA, 20 nt, Homo sapiens
acuggcuguuaaucuuucaa

SEQ ID NO: 41054 - RNA, 17 nt, Homo sapiens
acugggguggguggggc

SEQ ID NO: 41055 - RNA, 15 nt, Homo sapiens
acuguaagaaaauau

SEQ ID NO: 41056 - RNA, 16 nt, Homo sapiens
acuguaauuugugaua

SEQ ID NO: 41057 - RNA, 12 nt, Homo sapiens
acuguacaugaa

SEQ ID NO: 41058 - RNA, 22 nt, Homo sapiens
acuguacccaaauggaaaguaa

SEQ ID NO: 41059 - RNA, 15 nt, Homo sapiens
acugucaauuuggca

SEQ ID NO: 41060 - RNA, 15 nt, Homo sapiens
acuguccauucuucc

SEQ ID NO: 41061 - RNA, 16 nt, Homo sapiens
acuguccccaucauca

SEQ ID NO: 41062 - RNA, 20 nt, Homo sapiens
acuguccuauuauauucauu

SEQ ID NO: 41063 - RNA, 18 nt, Homo sapiens
acuguuauuuauaaucac

SEQ ID NO: 41064 - RNA, 19 nt, Homo sapiens
acuguuauuuauaaucacu

SEQ ID NO: 41065 - RNA, 20 nt, Homo sapiens
acuguuauuuauaaucacuu

SEQ ID NO: 41066 - RNA, 19 nt, Homo sapiens
acuguuuggauaugagaug

SEQ ID NO: 41067 - RNA, 17 nt, Homo sapiens
acuuaaaaucuaauuca

SEQ ID NO: 41068 - RNA, 18 nt, Homo sapiens
acuuaaaaucuaauucaa

SEQ ID NO: 41069 - RNA, 11 nt, Homo sapiens
acuuacuguac

SEQ ID NO: 41070 - RNA, 14 nt, Homo sapiens
acuuacuguacaug

SEQ ID NO: 41071 - RNA, 16 nt, Homo sapiens
acuuacuuaguguuau

SEQ ID NO: 41072 - RNA, 16 nt, Homo sapiens
acuuaguguacaugaa

SEQ ID NO: 41073 - RNA, 17 nt, Homo sapiens
acuuaugaaccuuuaca

SEQ ID NO: 41074 - RNA, 18 nt, Homo sapiens
acuuaugaaccuuuacau

SEQ ID NO: 41075 - RNA, 22 nt, Homo sapiens
acuuauuguagcauccuggaau

SEQ ID NO: 41076 - RNA, 13 nt, Homo sapiens
acuucaaauccuu

SEQ ID NO: 41077 - RNA, 12 nt, Homo sapiens
acuucacuuuuu

SEQ ID NO: 41078 - RNA, 17 nt, Homo sapiens
acuucauuaauaauaaa

SEQ ID NO: 41079 - RNA, 22 nt, Homo sapiens
acuuccagggcuacgcgcgcuc

SEQ ID NO: 41080 - RNA, 18 nt, Homo sapiens
acuucccgcuguuccucg

SEQ ID NO: 41081 - RNA, 20 nt, Homo sapiens
acuucccgcuguuccucgcc

SEQ ID NO: 41082 - RNA, 13 nt, Homo sapiens
acuuccucccggc

SEQ ID NO: 41083 - RNA, 14 nt, Homo sapiens
acuuccucccggcc

SEQ ID NO: 41084 - RNA, 18 nt, Homo sapiens
acuuccucccggccgcgc

SEQ ID NO: 41085 - RNA, 19 nt, Homo sapiens
acuuccucccggccgcgcu

SEQ ID NO: 41086 - RNA, 22 nt, Homo sapiens
acuuccucccggccgcgcugcg

SEQ ID NO: 41087 - RNA, 23 nt, Homo sapiens
acuuccucccggccgcgcugcgc

SEQ ID NO: 41088 - RNA, 20 nt, Homo sapiens
acuucuaaguaaaaccacag

SEQ ID NO: 41089 - RNA, 21 nt, Homo sapiens
acuucugucuucacaacagau

SEQ ID NO: 41090 - RNA, 22 nt, Homo sapiens
acuucugucuucacaacagauu

SEQ ID NO: 41091 - RNA, 14 nt, Homo sapiens
acuucuuaggguua

SEQ ID NO: 41092 - RNA, 20 nt, Homo sapiens
acuucuucucauacuauuua

SEQ ID NO: 41093 - RNA, 20 nt, Homo sapiens
acuugaaugugucaggugac

SEQ ID NO: 41094 - RNA, 15 nt, Homo sapiens
acuugaugauacaau

SEQ ID NO: 41095 - RNA, 21 nt, Homo sapiens
acuuggacaugggccccagau

SEQ ID NO: 41096 - RNA, 14 nt, Homo sapiens
acuugggaggcuga

SEQ ID NO: 41097 - RNA, 14 nt, Homo sapiens
acuuuaacacagug

SEQ ID NO: 41098 - RNA, 20 nt, Homo sapiens
acuuuaacacagugucuggc

SEQ ID NO: 41099 - RNA, 20 nt, Homo sapiens
acuuuaccuuuuuuauacau

SEQ ID NO: 41100 - RNA, 13 nt, Homo sapiens
acuuuccaauaaa

SEQ ID NO: 41101 - RNA, 14 nt, Homo sapiens
acuuuccaauaaag

SEQ ID NO: 41102 - RNA, 12 nt, Homo sapiens
acuuuccagaga

SEQ ID NO: 41103 - RNA, 23 nt, Homo sapiens
acuuugaccucugcagcaauaaa

SEQ ID NO: 41104 - RNA, 20 nt, Homo sapiens
acuuugauuuuauaugcuau

SEQ ID NO: 41105 - RNA, 15 nt, Homo sapiens
acuuugggaggcuga

SEQ ID NO: 41106 - RNA, 16 nt, Homo sapiens
acuuuuaaacuuugau

SEQ ID NO: 41107 - RNA, 13 nt, Homo sapiens
acuuuuauaagaa

SEQ ID NO: 41108 - RNA, 19 nt, Homo sapiens
acuuuuggaagguauuuaa

SEQ ID NO: 41109 - RNA, 21 nt, Homo sapiens
acuuuuggaagguauuuaaua

SEQ ID NO: 41110 - RNA, 15 nt, Homo sapiens
acuuuuggcuuguaa

SEQ ID NO: 41111 - RNA, 16 nt, Homo sapiens
acuuuuguguaaugaa

SEQ ID NO: 41112 - RNA, 11 nt, Homo sapiens
acuuuuuccag

SEQ ID NO: 41113 - RNA, 13 nt, Homo sapiens
acuuuuugcagcu

SEQ ID NO: 41114 - RNA, 15 nt, Homo sapiens
acuuuuuuucuuuuc

SEQ ID NO: 41115 - RNA, 17 nt, Homo sapiens
agaaaaaggaugcacag

SEQ ID NO: 41116 - RNA, 20 nt, Homo sapiens
agaaaaguugaauuuuacau

SEQ ID NO: 41117 - RNA, 20 nt, Homo sapiens
agaaaauaguggugugauuu

SEQ ID NO: 41118 - RNA, 16 nt, Homo sapiens
agaaaauggccaguga

SEQ ID NO: 41119 - RNA, 14 nt, Homo sapiens
agaaacacaacuau

SEQ ID NO: 41120 - RNA, 12 nt, Homo sapiens
agaaacauuugg

SEQ ID NO: 41121 - RNA, 20 nt, Homo sapiens
agaaaccuuauuguaccucu

SEQ ID NO: 41122 - RNA, 14 nt, Homo sapiens
agaaagacuauuca

SEQ ID NO: 41123 - RNA, 23 nt, Homo sapiens
agaaagacuauucaaacagucuc

SEQ ID NO: 41124 - RNA, 21 nt, Homo sapiens
agaaaggacccucaagacaaa

SEQ ID NO: 41125 - RNA, 18 nt, Homo sapiens
agaaauaaaccuaugaau

SEQ ID NO: 41126 - RNA, 14 nt, Homo sapiens
agaaauguguuauc

SEQ ID NO: 41127 - RNA, 16 nt, Homo sapiens
agaaauuaaguaucug

SEQ ID NO: 41128 - RNA, 22 nt, Homo sapiens
agaaauuaaguaucugacaucu

SEQ ID NO: 41129 - RNA, 19 nt, Homo sapiens
agaaauuugccaauuuacu

SEQ ID NO: 41130 - RNA, 14 nt, Homo sapiens
agaacuugaaugug

SEQ ID NO: 41131 - RNA, 18 nt, Homo sapiens
agaagaaaauaguggugu

SEQ ID NO: 41132 - RNA, 16 nt, Homo sapiens
agaagaaugacuaugc

SEQ ID NO: 41133 - RNA, 15 nt, Homo sapiens
agaagacaacauuaa

SEQ ID NO: 41134 - RNA, 13 nt, Homo sapiens
agaagagccggag

SEQ ID NO: 41135 - RNA, 15 nt, Homo sapiens
agaagagccggagcc

SEQ ID NO: 41136 - RNA, 16 nt, Homo sapiens
agaagagccggagccu

SEQ ID NO: 41137 - RNA, 23 nt, Homo sapiens
agaagagccggagccuccagcug

SEQ ID NO: 41138 - RNA, 14 nt, Homo sapiens
agaagagcuguuca

SEQ ID NO: 41139 - RNA, 16 nt, Homo sapiens
agaagaugguaccacc

SEQ ID NO: 41140 - RNA, 17 nt, Homo sapiens
agaagaugguaccacca

SEQ ID NO: 41141 - RNA, 21 nt, Homo sapiens
agaagaugguaccaccagucu

SEQ ID NO: 41142 - RNA, 22 nt, Homo sapiens
agaagucaaggcuuagacccuc

SEQ ID NO: 41143 - RNA, 19 nt, Homo sapiens
agaaguuaagcaacaucua

SEQ ID NO: 41144 - RNA, 13 nt, Homo sapiens
agaauauauuucc

SEQ ID NO: 41145 - RNA, 23 nt, Homo sapiens
agaaugaccuggccgcagugagg

SEQ ID NO: 41146 - RNA, 21 nt, Homo sapiens
agaaugauuuuacggagauau

SEQ ID NO: 41147 - RNA, 13 nt, Homo sapiens
agaauggaacuca

SEQ ID NO: 41148 - RNA, 21 nt, Homo sapiens
agaauguuuucaaauguucuc

SEQ ID NO: 41149 - RNA, 15 nt, Homo sapiens
agaauuaacacauga

SEQ ID NO: 41150 - RNA, 15 nt, Homo sapiens
agaauucuuacaugu

SEQ ID NO: 41151 - RNA, 16 nt, Homo sapiens
agaauucuuacauguu

SEQ ID NO: 41152 - RNA, 21 nt, Homo sapiens
agaauuuauucaauuccucug

SEQ ID NO: 41153 - RNA, 17 nt, Homo sapiens
agacaagaaggaaagau

SEQ ID NO: 41154 - RNA, 11 nt, Homo sapiens
agacaccacca

SEQ ID NO: 41155 - RNA, 21 nt, Homo sapiens
agacaccaccacccuugccau

SEQ ID NO: 41156 - RNA, 22 nt, Homo sapiens
agacaccaccacccuugccaug

SEQ ID NO: 41157 - RNA, 14 nt, Homo sapiens
agacagaacuugaa

SEQ ID NO: 41158 - RNA, 17 nt, Homo sapiens
agacauacuaaccagca

SEQ ID NO: 41159 - RNA, 20 nt, Homo sapiens
agacauacuaaccagcagaa

SEQ ID NO: 41160 - RNA, 16 nt, Homo sapiens
agacccucaugcugcc

SEQ ID NO: 41161 - RNA, 20 nt, Homo sapiens
agacccucaugcugccaaua

SEQ ID NO: 41162 - RNA, 21 nt, Homo sapiens
agacccucaugcugccaauau

SEQ ID NO: 41163 - RNA, 22 nt, Homo sapiens
agaccuggucgucgucuugacu

SEQ ID NO: 41164 - RNA, 15 nt, Homo sapiens
agacgggguuugcca

SEQ ID NO: 41165 - RNA, 18 nt, Homo sapiens
agacgggguuugccaugc

SEQ ID NO: 41166 - RNA, 23 nt, Homo sapiens
agacgggguuugccaugcuggcc

SEQ ID NO: 41167 - RNA, 19 nt, Homo sapiens
agacgugauuuugcuguag

SEQ ID NO: 41168 - RNA, 13 nt, Homo sapiens
agacucugucuca

SEQ ID NO: 41169 - RNA, 14 nt, Homo sapiens
agacucugucucag

SEQ ID NO: 41170 - RNA, 15 nt, Homo sapiens
agacucugucucagu

SEQ ID NO: 41171 - RNA, 20 nt, Homo sapiens
agacugaguacguugugcau

SEQ ID NO: 41172 - RNA, 15 nt, Homo sapiens
agagaaaagacauaa

SEQ ID NO: 41173 - RNA, 15 nt, Homo sapiens
agagaaugagagaca

SEQ ID NO: 41174 - RNA, 16 nt, Homo sapiens
agagacagaaagcaga

SEQ ID NO: 41175 - RNA, 14 nt, Homo sapiens
agagaccacaagca

SEQ ID NO: 41176 - RNA, 17 nt, Homo sapiens
agagacgggguuugcca

SEQ ID NO: 41177 - RNA, 22 nt, Homo sapiens
agagacgggguuugccaugcug

SEQ ID NO: 41178 - RNA, 17 nt, Homo sapiens
agagccggagccuccag

SEQ ID NO: 41179 - RNA, 18 nt, Homo sapiens
agagccggagccuccagc

SEQ ID NO: 41180 - RNA, 21 nt, Homo sapiens
agaggaaugaaguacucauac

SEQ ID NO: 41181 - RNA, 17 nt, Homo sapiens
agaggagaaacuggaac

SEQ ID NO: 41182 - RNA, 12 nt, Homo sapiens
agaggcagcuug

SEQ ID NO: 41183 - RNA, 13 nt, Homo sapiens
agaggcagcuuga

SEQ ID NO: 41184 - RNA, 19 nt, Homo sapiens
agaggguguguaaguagau

SEQ ID NO: 41185 - RNA, 23 nt, Homo sapiens
agagucuauuuacggaacucaaa

SEQ ID NO: 41186 - RNA, 22 nt, Homo sapiens
agaguucugucacggucacuuu

SEQ ID NO: 41187 - RNA, 22 nt, Homo sapiens
agaguucugucuggacuuucca

SEQ ID NO: 41188 - RNA, 16 nt, Homo sapiens
agaguuguuacauuuu

SEQ ID NO: 41189 - RNA, 15 nt, Homo sapiens
agauacugaaauaaa

SEQ ID NO: 41190 - RNA, 20 nt, Homo sapiens
agauacugaaauaaacgucu

SEQ ID NO: 41191 - RNA, 11 nt, Homo sapiens
agauagcaggg

SEQ ID NO: 41192 - RNA, 17 nt, Homo sapiens
agauagguuaccaguaa

SEQ ID NO: 41193 - RNA, 23 nt, Homo sapiens
agauagguuaccaguaacggaac

SEQ ID NO: 41194 - RNA, 13 nt, Homo sapiens
agauaugaggcau

SEQ ID NO: 41195 - RNA, 23 nt, Homo sapiens
agauaugaggcauuugcagcugu

SEQ ID NO: 41196 - RNA, 14 nt, Homo sapiens
agauaugauucaaa

SEQ ID NO: 41197 - RNA, 21 nt, Homo sapiens
agauauuuugcuuugugauuu

SEQ ID NO: 41198 - RNA, 13 nt, Homo sapiens
agaucaagccauc

SEQ ID NO: 41199 - RNA, 21 nt, Homo sapiens
agaucaagccugccucaauca

SEQ ID NO: 41200 - RNA, 13 nt, Homo sapiens
agaucauugugaa

SEQ ID NO: 41201 - RNA, 12 nt, Homo sapiens
agauccuggaaa

SEQ ID NO: 41202 - RNA, 15 nt, Homo sapiens
agauccuggaaauca

SEQ ID NO: 41203 - RNA, 16 nt, Homo sapiens
agaucucuaacuucac

SEQ ID NO: 41204 - RNA, 20 nt, Homo sapiens
agaucugcaacuacuaucca

SEQ ID NO: 41205 - RNA, 21 nt, Homo sapiens
agauguagauaaacucagaaa

SEQ ID NO: 41206 - RNA, 21 nt, Homo sapiens
agauguagcaaauuccaauac

SEQ ID NO: 41207 - RNA, 17 nt, Homo sapiens
agaugugggcagugaug

SEQ ID NO: 41208 - RNA, 22 nt, Homo sapiens
agaugugggcagugaugucacu

SEQ ID NO: 41209 - RNA, 23 nt, Homo sapiens
agauucaaugccccugaauuuaa

SEQ ID NO: 41210 - RNA, 21 nt, Homo sapiens
agauuuaccacuuguguuuug

SEQ ID NO: 41211 - RNA, 16 nt, Homo sapiens
agauuucaugccuggu

SEQ ID NO: 41212 - RNA, 21 nt, Homo sapiens
agauuucuuuccauugugggc

SEQ ID NO: 41213 - RNA, 18 nt, Homo sapiens
agcaaauguuaugcauaa

SEQ ID NO: 41214 - RNA, 17 nt, Homo sapiens
agcaaauuccaauacau

SEQ ID NO: 41215 - RNA, 21 nt, Homo sapiens
agcaaauuccaauacauuauu

SEQ ID NO: 41216 - RNA, 18 nt, Homo sapiens
agcaacccaaauguucau

SEQ ID NO: 41217 - RNA, 17 nt, Homo sapiens
agcaaggagauuuacaa

SEQ ID NO: 41218 - RNA, 21 nt, Homo sapiens
agcaaguauuagaauaccaca

SEQ ID NO: 41219 - RNA, 21 nt, Homo sapiens
agcacagccucuuagaugcag

SEQ ID NO: 41220 - RNA, 15 nt, Homo sapiens
agcaccaaucaugaa

SEQ ID NO: 41221 - RNA, 13 nt, Homo sapiens
agcaccugcaggc

SEQ ID NO: 41222 - RNA, 21 nt, Homo sapiens
agcaccugcaggcgugaccug

SEQ ID NO: 41223 - RNA, 22 nt, Homo sapiens
agcaccugcaggcgugaccuga

SEQ ID NO: 41224 - RNA, 15 nt, Homo sapiens
agcacgauuucuguu

SEQ ID NO: 41225 - RNA, 22 nt, Homo sapiens
agcacuuucccucuuggugccu

SEQ ID NO: 41226 - RNA, 14 nt, Homo sapiens
agcagaaaugccuu

SEQ ID NO: 41227 - RNA, 14 nt, Homo sapiens
agcagaacagugau

SEQ ID NO: 41228 - RNA, 22 nt, Homo sapiens
agcagagacgggguuugccaug

SEQ ID NO: 41229 - RNA, 21 nt, Homo sapiens
agcagauuuaagauauguaac

SEQ ID NO: 41230 - RNA, 14 nt, Homo sapiens
agcagcucauaaau

SEQ ID NO: 41231 - RNA, 18 nt, Homo sapiens
agcaggauagagugggac

SEQ ID NO: 41232 - RNA, 14 nt, Homo sapiens
agcagggacuugaa

SEQ ID NO: 41233 - RNA, 15 nt, Homo sapiens
agcagggacuugaac

SEQ ID NO: 41234 - RNA, 20 nt, Homo sapiens
agcagucagaagaccugguc

SEQ ID NO: 41235 - RNA, 21 nt, Homo sapiens
agcauaccaacacgagcaggc

SEQ ID NO: 41236 - RNA, 20 nt, Homo sapiens
agcauaguaccucugcuauu

SEQ ID NO: 41237 - RNA, 15 nt, Homo sapiens
agcaucacaguuuug

SEQ ID NO: 41238 - RNA, 13 nt, Homo sapiens
agcauccuggaau

SEQ ID NO: 41239 - RNA, 12 nt, Homo sapiens
agcaucucagga

SEQ ID NO: 41240 - RNA, 15 nt, Homo sapiens
agcaucucaggagau

SEQ ID NO: 41241 - RNA, 16 nt, Homo sapiens
agcaucucugaacauu

SEQ ID NO: 41242 - RNA, 17 nt, Homo sapiens
agcauuguaaaugugcu

SEQ ID NO: 41243 - RNA, 22 nt, Homo sapiens
agcauuguaaaugugcuuuuaa

SEQ ID NO: 41244 - RNA, 23 nt, Homo sapiens
agccaaccugggggcuuuaggga

SEQ ID NO: 41245 - RNA, 16 nt, Homo sapiens
agccacuucacuuuuu

SEQ ID NO: 41246 - RNA, 16 nt, Homo sapiens
agccagacaucaacag

SEQ ID NO: 41247 - RNA, 14 nt, Homo sapiens
agccagacuggcac

SEQ ID NO: 41248 - RNA, 20 nt, Homo sapiens
agccagauuuuccugaaaac

SEQ ID NO: 41249 - RNA, 15 nt, Homo sapiens
agccagcacagccuc

SEQ ID NO: 41250 - RNA, 17 nt, Homo sapiens
agccagcacagccucuu

SEQ ID NO: 41251 - RNA, 16 nt, Homo sapiens
agccagcccucuucug

SEQ ID NO: 41252 - RNA, 16 nt, Homo sapiens
agccagccuugcuccu

SEQ ID NO: 41253 - RNA, 13 nt, Homo sapiens
agccaggcggcug

SEQ ID NO: 41254 - RNA, 18 nt, Homo sapiens
agcccacuggcucccugg

SEQ ID NO: 41255 - RNA, 14 nt, Homo sapiens
agccccaauucgau

SEQ ID NO: 41256 - RNA, 23 nt, Homo sapiens
agccccaggcggguccgggucgc

SEQ ID NO: 41257 - RNA, 21 nt, Homo sapiens
agcccccauuguggucacagg

SEQ ID NO: 41258 - RNA, 15 nt, Homo sapiens
agccccgggaguggc

SEQ ID NO: 41259 - RNA, 15 nt, Homo sapiens
agccccugggaccag

SEQ ID NO: 41260 - RNA, 17 nt, Homo sapiens
agccccuugggcagguc

SEQ ID NO: 41261 - RNA, 15 nt, Homo sapiens
agcccggaaacucca

SEQ ID NO: 41262 - RNA, 12 nt, Homo sapiens
agcccuacacca

SEQ ID NO: 41263 - RNA, 15 nt, Homo sapiens
agcccucuucugaca

SEQ ID NO: 41264 - RNA, 23 nt, Homo sapiens
agcccucuucugacacuaaaaca

SEQ ID NO: 41265 - RNA, 20 nt, Homo sapiens
agcccuucaugcauuugcac

SEQ ID NO: 41266 - RNA, 17 nt, Homo sapiens
agccggagccuccagcu

SEQ ID NO: 41267 - RNA, 19 nt, Homo sapiens
agccggagccuccagcugc

SEQ ID NO: 41268 - RNA, 20 nt, Homo sapiens
agccggagccuccagcugcc

SEQ ID NO: 41269 - RNA, 13 nt, Homo sapiens
agccgggaaagaa

SEQ ID NO: 41270 - RNA, 15 nt, Homo sapiens
agccgggaaagaaga

SEQ ID NO: 41271 - RNA, 17 nt, Homo sapiens
agccgggaaagaagagc

SEQ ID NO: 41272 - RNA, 19 nt, Homo sapiens
agccgggaaagaagagccg

SEQ ID NO: 41273 - RNA, 21 nt, Homo sapiens
agccgggaaagaagagccgga

SEQ ID NO: 41274 - RNA, 22 nt, Homo sapiens
agccgggaaagaagagccggag

SEQ ID NO: 41275 - RNA, 23 nt, Homo sapiens
agccgggaaagaagagccggagc

SEQ ID NO: 41276 - RNA, 17 nt, Homo sapiens
agccgguccuugcugca

SEQ ID NO: 41277 - RNA, 20 nt, Homo sapiens
agccgguccuugcugcaccu

SEQ ID NO: 41278 - RNA, 21 nt, Homo sapiens
agccgguccuugcugcaccug

SEQ ID NO: 41279 - RNA, 15 nt, Homo sapiens
agccuaguugaucag

SEQ ID NO: 41280 - RNA, 16 nt, Homo sapiens
agccuccagcugcccc

SEQ ID NO: 41281 - RNA, 17 nt, Homo sapiens
agccuccagcugccccg

SEQ ID NO: 41282 - RNA, 18 nt, Homo sapiens
agccuccagcugccccgg

SEQ ID NO: 41283 - RNA, 19 nt, Homo sapiens
agccugaaagaggaaugaa

SEQ ID NO: 41284 - RNA, 20 nt, Homo sapiens
agccugaaagaggaaugaag

SEQ ID NO: 41285 - RNA, 15 nt, Homo sapiens
agccuggucaacaug

SEQ ID NO: 41286 - RNA, 16 nt, Homo sapiens
agccuggucaacaugg

SEQ ID NO: 41287 - RNA, 19 nt, Homo sapiens
agccuugcuccuggcuggg

SEQ ID NO: 41288 - RNA, 20 nt, Homo sapiens
agccuugcuccuggcugggg

SEQ ID NO: 41289 - RNA, 16 nt, Homo sapiens
agccuuggauacucca

SEQ ID NO: 41290 - RNA, 22 nt, Homo sapiens
agccuuggauacuccauggggu

SEQ ID NO: 41291 - RNA, 23 nt, Homo sapiens
agccuuuguugcuaucaauccaa

SEQ ID NO: 41292 - RNA, 16 nt, Homo sapiens
agcgacagugagacuc

SEQ ID NO: 41293 - RNA, 18 nt, Homo sapiens
agcgaguacuucccgcug

SEQ ID NO: 41294 - RNA, 11 nt, Homo sapiens
agcgcgcgcgc

SEQ ID NO: 41295 - RNA, 15 nt, Homo sapiens
agcgcgcgcgcccuc

SEQ ID NO: 41296 - RNA, 23 nt, Homo sapiens
agcgcgcgcgcccucuggcugcu

SEQ ID NO: 41297 - RNA, 16 nt, Homo sapiens
agcggaccuucccagc

SEQ ID NO: 41298 - RNA, 13 nt, Homo sapiens
agcgguuuauaua

SEQ ID NO: 41299 - RNA, 23 nt, Homo sapiens
agcuaaaguaucuguauugcauu

SEQ ID NO: 41300 - RNA, 14 nt, Homo sapiens
agcuaagauauaau

SEQ ID NO: 41301 - RNA, 23 nt, Homo sapiens
agcuaaguugcaccaacuuugaa

SEQ ID NO: 41302 - RNA, 12 nt, Homo sapiens
agcuacaggccc

SEQ ID NO: 41303 - RNA, 14 nt, Homo sapiens
agcuacaggcccca

SEQ ID NO: 41304 - RNA, 15 nt, Homo sapiens
agcuacaggccccau

SEQ ID NO: 41305 - RNA, 17 nt, Homo sapiens
agcuacuuauuguagca

SEQ ID NO: 41306 - RNA, 23 nt, Homo sapiens
agcuagaaaacaggcaaauuccu

SEQ ID NO: 41307 - RNA, 13 nt, Homo sapiens
agcuagaauuuga

SEQ ID NO: 41308 - RNA, 23 nt, Homo sapiens
agcuaggggggucagccagcccu

SEQ ID NO: 41309 - RNA, 13 nt, Homo sapiens
agcucacuggugg

SEQ ID NO: 41310 - RNA, 13 nt, Homo sapiens
agcucaggcuggc

SEQ ID NO: 41311 - RNA, 14 nt, Homo sapiens
agcucaggcuggca

SEQ ID NO: 41312 - RNA, 20 nt, Homo sapiens
agcucaggcuggcaccgcug

SEQ ID NO: 41313 - RNA, 23 nt, Homo sapiens
agcucaggcuggcaccgcuguac

SEQ ID NO: 41314 - RNA, 22 nt, Homo sapiens
agcuccaccuuacuucuucuca

SEQ ID NO: 41315 - RNA, 13 nt, Homo sapiens
agcucgugggaca

SEQ ID NO: 41316 - RNA, 13 nt, Homo sapiens
agcucuaucccaa

SEQ ID NO: 41317 - RNA, 18 nt, Homo sapiens
agcucuaucccaaccucu

SEQ ID NO: 41318 - RNA, 22 nt, Homo sapiens
agcucuaucccaaccucuccca

SEQ ID NO: 41319 - RNA, 19 nt, Homo sapiens
agcucugcccauccugccc

SEQ ID NO: 41320 - RNA, 15 nt, Homo sapiens
agcugaauacauucu

SEQ ID NO: 41321 - RNA, 14 nt, Homo sapiens
agcugccccgggga

SEQ ID NO: 41322 - RNA, 15 nt, Homo sapiens
agcugccccggggag

SEQ ID NO: 41323 - RNA, 16 nt, Homo sapiens
agcugccccggggagg

SEQ ID NO: 41324 - RNA, 22 nt, Homo sapiens
agcugccccggggaggggcgcu

SEQ ID NO: 41325 - RNA, 23 nt, Homo sapiens
agcugccccggggaggggcgcuc

SEQ ID NO: 41326 - RNA, 20 nt, Homo sapiens
agcugccuccccagcucuau

SEQ ID NO: 41327 - RNA, 22 nt, Homo sapiens
agcugccuccccagcucuaucc

SEQ ID NO: 41328 - RNA, 14 nt, Homo sapiens
agcuguaugauucc

SEQ ID NO: 41329 - RNA, 14 nt, Homo sapiens
agcuguugagcugu

SEQ ID NO: 41330 - RNA, 16 nt, Homo sapiens
agcuguuuucccugac

SEQ ID NO: 41331 - RNA, 15 nt, Homo sapiens
agcuuauucacaaga

SEQ ID NO: 41332 - RNA, 18 nt, Homo sapiens
agcuuauugucuagugaa

SEQ ID NO: 41333 - RNA, 14 nt, Homo sapiens
agcuucucugugaa

SEQ ID NO: 41334 - RNA, 20 nt, Homo sapiens
agcuugaaacugagauguga

SEQ ID NO: 41335 - RNA, 19 nt, Homo sapiens
agcuugaaauagugucuga

SEQ ID NO: 41336 - RNA, 17 nt, Homo sapiens
agcuuucucuaguucaa

SEQ ID NO: 41337 - RNA, 12 nt, Homo sapiens
agcuuuuguaga

SEQ ID NO: 41338 - RNA, 13 nt, Homo sapiens
agcuuuuguagaa

SEQ ID NO: 41339 - RNA, 14 nt, Homo sapiens
agcuuuuguagaag

SEQ ID NO: 41340 - RNA, 20 nt, Homo sapiens
agcuuuuuucucugauacag

SEQ ID NO: 41341 - RNA, 17 nt, Homo sapiens
aggaaaaucugcacugu

SEQ ID NO: 41342 - RNA, 22 nt, Homo sapiens
aggaaacuggguuccugcaaug

SEQ ID NO: 41343 - RNA, 15 nt, Homo sapiens
aggaaagauuuuguu

SEQ ID NO: 41344 - RNA, 22 nt, Homo sapiens
aggaaaucaaauaugcaaagca

SEQ ID NO: 41345 - RNA, 16 nt, Homo sapiens
aggaacagaagaggaa

SEQ ID NO: 41346 - RNA, 19 nt, Homo sapiens
aggaaggaggaagcuuauu

SEQ ID NO: 41347 - RNA, 17 nt, Homo sapiens
aggaauacauaaaguau

SEQ ID NO: 41348 - RNA, 19 nt, Homo sapiens
aggaauacauaaaguaugu

SEQ ID NO: 41349 - RNA, 13 nt, Homo sapiens
aggaauauuugca

SEQ ID NO: 41350 - RNA, 21 nt, Homo sapiens
aggaauauuugcaagacauag

SEQ ID NO: 41351 - RNA, 13 nt, Homo sapiens
aggaauugaccca

SEQ ID NO: 41352 - RNA, 13 nt, Homo sapiens
aggacugaauuau

SEQ ID NO: 41353 - RNA, 19 nt, Homo sapiens
aggagaaacuggaacucuc

SEQ ID NO: 41354 - RNA, 21 nt, Homo sapiens
aggaggcauccaaaggcuccu

SEQ ID NO: 41355 - RNA, 14 nt, Homo sapiens
aggaggcccugccc

SEQ ID NO: 41356 - RNA, 13 nt, Homo sapiens
aggaggggcuucu

SEQ ID NO: 41357 - RNA, 22 nt, Homo sapiens
aggaguuccuaaccagccuggu

SEQ ID NO: 41358 - RNA, 13 nt, Homo sapiens
aggaguuuggcca

SEQ ID NO: 41359 - RNA, 15 nt, Homo sapiens
aggaguuuggccaga

SEQ ID NO: 41360 - RNA, 16 nt, Homo sapiens
aggaguuuggccagaa

SEQ ID NO: 41361 - RNA, 16 nt, Homo sapiens
aggaugcacagaguug

SEQ ID NO: 41362 - RNA, 13 nt, Homo sapiens
aggaugcccacgg

SEQ ID NO: 41363 - RNA, 21 nt, Homo sapiens
aggauggcaggaggcauccaa

SEQ ID NO: 41364 - RNA, 10 nt, Homo sapiens
aggaugguuc

SEQ ID NO: 41365 - RNA, 12 nt, Homo sapiens
aggaugguuccc

SEQ ID NO: 41366 - RNA, 15 nt, Homo sapiens
aggauuuaaguuuca

SEQ ID NO: 41367 - RNA, 17 nt, Homo sapiens
aggauuuuaugcuuuaa

SEQ ID NO: 41368 - RNA, 12 nt, Homo sapiens
aggcaagagaau

SEQ ID NO: 41369 - RNA, 18 nt, Homo sapiens
aggcacccccagaaugac

SEQ ID NO: 41370 - RNA, 20 nt, Homo sapiens
aggcacccccagaaugaccu

SEQ ID NO: 41371 - RNA, 17 nt, Homo sapiens
aggcagaagcaacccaa

SEQ ID NO: 41372 - RNA, 22 nt, Homo sapiens
aggcauccaaaggcuccugaga

SEQ ID NO: 41373 - RNA, 12 nt, Homo sapiens
aggcauguaauu

SEQ ID NO: 41374 - RNA, 18 nt, Homo sapiens
aggcauguaauugcuugu

SEQ ID NO: 41375 - RNA, 11 nt, Homo sapiens
aggcauucucu

SEQ ID NO: 41376 - RNA, 19 nt, Homo sapiens
aggcauuugcagcugugcc

SEQ ID NO: 41377 - RNA, 13 nt, Homo sapiens
aggcccccgggcc

SEQ ID NO: 41378 - RNA, 14 nt, Homo sapiens
aggcccccgggccg

SEQ ID NO: 41379 - RNA, 16 nt, Homo sapiens
aggcccccgggccgac

SEQ ID NO: 41380 - RNA, 19 nt, Homo sapiens
aggcccccgggccgacgga

SEQ ID NO: 41381 - RNA, 23 nt, Homo sapiens
aggcccccgggccgacggagccg

SEQ ID NO: 41382 - RNA, 16 nt, Homo sapiens
aggcccuagcauuucu

SEQ ID NO: 41383 - RNA, 10 nt, Homo sapiens
aggccgggcg

SEQ ID NO: 41384 - RNA, 12 nt, Homo sapiens
aggcggguccgg

SEQ ID NO: 41385 - RNA, 14 nt, Homo sapiens
aggcggguccgggu

SEQ ID NO: 41386 - RNA, 17 nt, Homo sapiens
aggcggguccgggucgc

SEQ ID NO: 41387 - RNA, 18 nt, Homo sapiens
aggcggguccgggucgca

SEQ ID NO: 41388 - RNA, 20 nt, Homo sapiens
aggcggguccgggucgcagg

SEQ ID NO: 41389 - RNA, 21 nt, Homo sapiens
aggcggguccgggucgcagga

SEQ ID NO: 41390 - RNA, 14 nt, Homo sapiens
aggcggguggauca

SEQ ID NO: 41391 - RNA, 15 nt, Homo sapiens
aggcggguggaucac

SEQ ID NO: 41392 - RNA, 20 nt, Homo sapiens
aggcggguggaucacuugag

SEQ ID NO: 41393 - RNA, 20 nt, Homo sapiens
aggcgugaccugacagccca

SEQ ID NO: 41394 - RNA, 15 nt, Homo sapiens
aggcgugagccacca

SEQ ID NO: 41395 - RNA, 17 nt, Homo sapiens
aggcuagaaccaccugc

SEQ ID NO: 41396 - RNA, 13 nt, Homo sapiens
aggcuccaaacug

SEQ ID NO: 41397 - RNA, 21 nt, Homo sapiens
aggcuggagugcaguggcgca

SEQ ID NO: 41398 - RNA, 14 nt, Homo sapiens
aggcuggcaccgcu

SEQ ID NO: 41399 - RNA, 13 nt, Homo sapiens
aggcuggucucga

SEQ ID NO: 41400 - RNA, 23 nt, Homo sapiens
aggcuggucucgaacugcuggau

SEQ ID NO: 41401 - RNA, 17 nt, Homo sapiens
aggcuuagacccucaug

SEQ ID NO: 41402 - RNA, 22 nt, Homo sapiens
aggcuuagacccucaugcugcc

SEQ ID NO: 41403 - RNA, 23 nt, Homo sapiens
aggcuuagacccucaugcugcca

SEQ ID NO: 41404 - RNA, 19 nt, Homo sapiens
agggaacugaacauuccag

SEQ ID NO: 41405 - RNA, 16 nt, Homo sapiens
agggaagggggaacau

SEQ ID NO: 41406 - RNA, 11 nt, Homo sapiens
agggaccugcu

SEQ ID NO: 41407 - RNA, 14 nt, Homo sapiens
agggaccugcuguu

SEQ ID NO: 41408 - RNA, 21 nt, Homo sapiens
agggagccgguccuugcugca

SEQ ID NO: 41409 - RNA, 16 nt, Homo sapiens
agggauuccccuaacc

SEQ ID NO: 41410 - RNA, 17 nt, Homo sapiens
agggccuggcugggagu

SEQ ID NO: 41411 - RNA, 15 nt, Homo sapiens
agggcgcggggcggg

SEQ ID NO: 41412 - RNA, 16 nt, Homo sapiens
agggcgcggggcgggg

SEQ ID NO: 41413 - RNA, 15 nt, Homo sapiens
agggcuacgcgcgcu

SEQ ID NO: 41414 - RNA, 16 nt, Homo sapiens
agggcuacgcgcgcuc

SEQ ID NO: 41415 - RNA, 17 nt, Homo sapiens
agggcuacgcgcgcucc

SEQ ID NO: 41416 - RNA, 18 nt, Homo sapiens
agggcuacgcgcgcuccg

SEQ ID NO: 41417 - RNA, 20 nt, Homo sapiens
agggcuacgcgcgcuccgcg

SEQ ID NO: 41418 - RNA, 21 nt, Homo sapiens
agggcuacgcgcgcuccgcgc

SEQ ID NO: 41419 - RNA, 14 nt, Homo sapiens
agggcuugaggacu

SEQ ID NO: 41420 - RNA, 20 nt, Homo sapiens
agggcuugugugcacauauc

SEQ ID NO: 41421 - RNA, 21 nt, Homo sapiens
agggcuugugugcacauaucc

SEQ ID NO: 41422 - RNA, 17 nt, Homo sapiens
aggggaaggcaacauac

SEQ ID NO: 41423 - RNA, 11 nt, Homo sapiens
aggggcgcucg

SEQ ID NO: 41424 - RNA, 12 nt, Homo sapiens
aggggcgcucgc

SEQ ID NO: 41425 - RNA, 17 nt, Homo sapiens
aggggcgcucgcuuccg

SEQ ID NO: 41426 - RNA, 18 nt, Homo sapiens
aggggcgcucgcuuccgc

SEQ ID NO: 41427 - RNA, 22 nt, Homo sapiens
aggggcgcucgcuuccgcaucc

SEQ ID NO: 41428 - RNA, 11 nt, Homo sapiens
aggggcggcgg

SEQ ID NO: 41429 - RNA, 13 nt, Homo sapiens
aggggcggcggcc

SEQ ID NO: 41430 - RNA, 14 nt, Homo sapiens
aggggcggcggccc

SEQ ID NO: 41431 - RNA, 20 nt, Homo sapiens
aggggcggcggcccugugcg

SEQ ID NO: 41432 - RNA, 15 nt, Homo sapiens
aggguacacugccuu

SEQ ID NO: 41433 - RNA, 22 nt, Homo sapiens
aggguccuuugggaaaggagaa

SEQ ID NO: 41434 - RNA, 21 nt, Homo sapiens
agggucucccucuguugccaa

SEQ ID NO: 41435 - RNA, 17 nt, Homo sapiens
aggguggguggggugag

SEQ ID NO: 41436 - RNA, 16 nt, Homo sapiens
agguaccuucucaccu

SEQ ID NO: 41437 - RNA, 18 nt, Homo sapiens
agguacugagagugaaca

SEQ ID NO: 41438 - RNA, 20 nt, Homo sapiens
agguagaauguuuucaaaug

SEQ ID NO: 41439 - RNA, 20 nt, Homo sapiens
agguauauaaauuuucccaa

SEQ ID NO: 41440 - RNA, 17 nt, Homo sapiens
agguauuuuaaucacca

SEQ ID NO: 41441 - RNA, 18 nt, Homo sapiens
agguauuuuaaucaccaa

SEQ ID NO: 41442 - RNA, 17 nt, Homo sapiens
aggucacacaaccuguc

SEQ ID NO: 41443 - RNA, 23 nt, Homo sapiens
agguccuggcaaagaugaucagu

SEQ ID NO: 41444 - RNA, 20 nt, Homo sapiens
aggucuaccaaaaaucucaa

SEQ ID NO: 41445 - RNA, 13 nt, Homo sapiens
aggucuccaaaau

SEQ ID NO: 41446 - RNA, 10 nt, Homo sapiens
aggugaccau

SEQ ID NO: 41447 - RNA, 18 nt, Homo sapiens
aggugagcaggugaugcc

SEQ ID NO: 41448 - RNA, 17 nt, Homo sapiens
aggugcuacaaaaacac

SEQ ID NO: 41449 - RNA, 13 nt, Homo sapiens
agguuaagcacuu

SEQ ID NO: 41450 - RNA, 15 nt, Homo sapiens
agguuaagcacuuua

SEQ ID NO: 41451 - RNA, 17 nt, Homo sapiens
agguuccugagcccuac

SEQ ID NO: 41452 - RNA, 19 nt, Homo sapiens
agguucuggugugaacuaa

SEQ ID NO: 41453 - RNA, 15 nt, Homo sapiens
agguuucgauauuua

SEQ ID NO: 41454 - RNA, 20 nt, Homo sapiens
agguuuggacaaaauggaau

SEQ ID NO: 41455 - RNA, 21 nt, Homo sapiens
agguuuuucuuaaauaauaaa

SEQ ID NO: 41456 - RNA, 13 nt, Homo sapiens
aguaaaaccacag

SEQ ID NO: 41457 - RNA, 18 nt, Homo sapiens
aguaaaaccacagcaguu

SEQ ID NO: 41458 - RNA, 14 nt, Homo sapiens
aguaauaugcacac

SEQ ID NO: 41459 - RNA, 12 nt, Homo sapiens
aguaaugauaac

SEQ ID NO: 41460 - RNA, 20 nt, Homo sapiens
aguaauuuuaaguaauuuca

SEQ ID NO: 41461 - RNA, 23 nt, Homo sapiens
aguacacuguuucaaacuuuacu

SEQ ID NO: 41462 - RNA, 14 nt, Homo sapiens
aguacagacuuuuu

SEQ ID NO: 41463 - RNA, 14 nt, Homo sapiens
aguacguugugcau

SEQ ID NO: 41464 - RNA, 16 nt, Homo sapiens
aguacguugugcauuu

SEQ ID NO: 41465 - RNA, 17 nt, Homo sapiens
aguacucauacauguua

SEQ ID NO: 41466 - RNA, 14 nt, Homo sapiens
aguacuucccgcug

SEQ ID NO: 41467 - RNA, 22 nt, Homo sapiens
aguacuucccgcuguuccucgc

SEQ ID NO: 41468 - RNA, 23 nt, Homo sapiens
aguacuucccgcuguuccucgcc

SEQ ID NO: 41469 - RNA, 18 nt, Homo sapiens
aguagauaugaggcauuu

SEQ ID NO: 41470 - RNA, 15 nt, Homo sapiens
aguagcagcagcauc

SEQ ID NO: 41471 - RNA, 16 nt, Homo sapiens
aguaucccuacuguaa

SEQ ID NO: 41472 - RNA, 19 nt, Homo sapiens
aguaucccuacuguaauuu

SEQ ID NO: 41473 - RNA, 23 nt, Homo sapiens
aguaugaaaaugucauuguucuu

SEQ ID NO: 41474 - RNA, 19 nt, Homo sapiens
aguaugcacuaaucaauac

SEQ ID NO: 41475 - RNA, 13 nt, Homo sapiens
aguaugugcauau

SEQ ID NO: 41476 - RNA, 14 nt, Homo sapiens
aguaugugcauuua

SEQ ID NO: 41477 - RNA, 15 nt, Homo sapiens
aguaugugcauuuaa

SEQ ID NO: 41478 - RNA, 13 nt, Homo sapiens
aguauuucuauga

SEQ ID NO: 41479 - RNA, 18 nt, Homo sapiens
aguauuucuaugaaauau

SEQ ID NO: 41480 - RNA, 22 nt, Homo sapiens
agucaaggcuuagacccucaug

SEQ ID NO: 41481 - RNA, 15 nt, Homo sapiens
agucaccucauggaa

SEQ ID NO: 41482 - RNA, 15 nt, Homo sapiens
agucagaagaccugg

SEQ ID NO: 41483 - RNA, 21 nt, Homo sapiens
agucccagaucaagccugccu

SEQ ID NO: 41484 - RNA, 22 nt, Homo sapiens
agucccagaucaagccugccuc

SEQ ID NO: 41485 - RNA, 11 nt, Homo sapiens
agucccugcug

SEQ ID NO: 41486 - RNA, 12 nt, Homo sapiens
agucccugcugc

SEQ ID NO: 41487 - RNA, 15 nt, Homo sapiens
agucccugcugcccu

SEQ ID NO: 41488 - RNA, 16 nt, Homo sapiens
agucccugcugcccuu

SEQ ID NO: 41489 - RNA, 16 nt, Homo sapiens
agucucaggaaaucaa

SEQ ID NO: 41490 - RNA, 16 nt, Homo sapiens
agucucuaucauuaaa

SEQ ID NO: 41491 - RNA, 18 nt, Homo sapiens
agucucuaucauuaaagu

SEQ ID NO: 41492 - RNA, 22 nt, Homo sapiens
agucucugaagugaaacugcuu

SEQ ID NO: 41493 - RNA, 17 nt, Homo sapiens
agucuguuuuaugacuu

SEQ ID NO: 41494 - RNA, 13 nt, Homo sapiens
agucuucuauuua

SEQ ID NO: 41495 - RNA, 14 nt, Homo sapiens
agucuucuauuuau

SEQ ID NO: 41496 - RNA, 12 nt, Homo sapiens
agugaaacugcu

SEQ ID NO: 41497 - RNA, 13 nt, Homo sapiens
agugaaacugcuu

SEQ ID NO: 41498 - RNA, 19 nt, Homo sapiens
agugaacaaauuuacagag

SEQ ID NO: 41499 - RNA, 20 nt, Homo sapiens
agugacaagcucacagaccu

SEQ ID NO: 41500 - RNA, 16 nt, Homo sapiens
agugagacucugucuc

SEQ ID NO: 41501 - RNA, 15 nt, Homo sapiens
agugagcugauauca

SEQ ID NO: 41502 - RNA, 19 nt, Homo sapiens
agugaucaaguuauuuuua

SEQ ID NO: 41503 - RNA, 21 nt, Homo sapiens
agugaucaaguuauuuuuaau

SEQ ID NO: 41504 - RNA, 15 nt, Homo sapiens
agugcaguggcgcaa

SEQ ID NO: 41505 - RNA, 17 nt, Homo sapiens
agugcccaacuguuaua

SEQ ID NO: 41506 - RNA, 12 nt, Homo sapiens
agugcugcauuu

SEQ ID NO: 41507 - RNA, 13 nt, Homo sapiens
agugcugcauuua

SEQ ID NO: 41508 - RNA, 16 nt, Homo sapiens
agugcugcauuuaaaa

SEQ ID NO: 41509 - RNA, 22 nt, Homo sapiens
agugcugggaauuacaggcgug

SEQ ID NO: 41510 - RNA, 14 nt, Homo sapiens
agugcuuggcccag

SEQ ID NO: 41511 - RNA, 17 nt, Homo sapiens
agugcuuggcccaggag

SEQ ID NO: 41512 - RNA, 22 nt, Homo sapiens
agugcuuugagauugugaaauu

SEQ ID NO: 41513 - RNA, 19 nt, Homo sapiens
aguggcauguaugacguga

SEQ ID NO: 41514 - RNA, 18 nt, Homo sapiens
aguggcgcgcgccaccac

SEQ ID NO: 41515 - RNA, 20 nt, Homo sapiens
aguggcgcgcgccaccacgc

SEQ ID NO: 41516 - RNA, 14 nt, Homo sapiens
agugggacaguucc

SEQ ID NO: 41517 - RNA, 23 nt, Homo sapiens
agugguuauuuagggaacugcuu

SEQ ID NO: 41518 - RNA, 15 nt, Homo sapiens
agugugaggaaaacc

SEQ ID NO: 41519 - RNA, 23 nt, Homo sapiens
aguguguggucaacauuucucau

SEQ ID NO: 41520 - RNA, 23 nt, Homo sapiens
aguguuggagaagaacugaaauc

SEQ ID NO: 41521 - RNA, 11 nt, Homo sapiens
aguuaagaauc

SEQ ID NO: 41522 - RNA, 20 nt, Homo sapiens
aguuaggcuauucacaacca

SEQ ID NO: 41523 - RNA, 11 nt, Homo sapiens
aguuauaaaaa

SEQ ID NO: 41524 - RNA, 19 nt, Homo sapiens
aguuauggcuauaggugcu

SEQ ID NO: 41525 - RNA, 14 nt, Homo sapiens
aguuauuuuuaaac

SEQ ID NO: 41526 - RNA, 15 nt, Homo sapiens
aguucaauccugauu

SEQ ID NO: 41527 - RNA, 21 nt, Homo sapiens
aguucaaucuggauucauauu

SEQ ID NO: 41528 - RNA, 21 nt, Homo sapiens
aguucugaagaagaugguacc

SEQ ID NO: 41529 - RNA, 18 nt, Homo sapiens
aguucuucaaagauaggg

SEQ ID NO: 41530 - RNA, 12 nt, Homo sapiens
aguugaucagcu

SEQ ID NO: 41531 - RNA, 18 nt, Homo sapiens
aguugauuuuacaauuga

SEQ ID NO: 41532 - RNA, 18 nt, Homo sapiens
aguugcagcccugcugcu

SEQ ID NO: 41533 - RNA, 15 nt, Homo sapiens
aguugcagugagcug

SEQ ID NO: 41534 - RNA, 16 nt, Homo sapiens
aguugcagugagcuga

SEQ ID NO: 41535 - RNA, 11 nt, Homo sapiens
aguugcuguau

SEQ ID NO: 41536 - RNA, 15 nt, Homo sapiens
aguuguuaauaaaag

SEQ ID NO: 41537 - RNA, 17 nt, Homo sapiens
aguuuauauacaauuau

SEQ ID NO: 41538 - RNA, 18 nt, Homo sapiens
aguuuaugcauacaguaa

SEQ ID NO: 41539 - RNA, 17 nt, Homo sapiens
aguuuuacaguguuucu

SEQ ID NO: 41540 - RNA, 13 nt, Homo sapiens
aguuuuauaugcu

SEQ ID NO: 41541 - RNA, 17 nt, Homo sapiens
aguuuuauaugcuucug

SEQ ID NO: 41542 - RNA, 20 nt, Homo sapiens
aguuuucugcuuuaauuuca

SEQ ID NO: 41543 - RNA, 22 nt, Homo sapiens
aguuuuuauggcuuuugugcau

SEQ ID NO: 41544 - RNA, 16 nt, Homo sapiens
auaaaaaggugaccau

SEQ ID NO: 41545 - RNA, 14 nt, Homo sapiens
auaaaauaauuuuu

SEQ ID NO: 41546 - RNA, 19 nt, Homo sapiens
auaaaauaauuuuuauauu

SEQ ID NO: 41547 - RNA, 16 nt, Homo sapiens
auaaaauacauacuau

SEQ ID NO: 41548 - RNA, 12 nt, Homo sapiens
auaaaauauuua

SEQ ID NO: 41549 - RNA, 14 nt, Homo sapiens
auaaaauauuuaaa

SEQ ID NO: 41550 - RNA, 16 nt, Homo sapiens
auaaaauucauuccau

SEQ ID NO: 41551 - RNA, 19 nt, Homo sapiens
auaaacaagaccacguuuc

SEQ ID NO: 41552 - RNA, 18 nt, Homo sapiens
auaaacagcaacuugugu

SEQ ID NO: 41553 - RNA, 18 nt, Homo sapiens
auaaacaguagugauagu

SEQ ID NO: 41554 - RNA, 20 nt, Homo sapiens
auaaaccuaugaauaaauuu

SEQ ID NO: 41555 - RNA, 15 nt, Homo sapiens
auaaaguaugugcau

SEQ ID NO: 41556 - RNA, 18 nt, Homo sapiens
auaaaguguaaguucaca

SEQ ID NO: 41557 - RNA, 21 nt, Homo sapiens
auaaauaguuuaugauuccac

SEQ ID NO: 41558 - RNA, 22 nt, Homo sapiens
auaaaucgcuuuugauaaucaa

SEQ ID NO: 41559 - RNA, 23 nt, Homo sapiens
auaaaucgcuuuugauaaucaac

SEQ ID NO: 41560 - RNA, 14 nt, Homo sapiens
auaaauggacaaau

SEQ ID NO: 41561 - RNA, 20 nt, Homo sapiens
auaaauguugacaugggaca

SEQ ID NO: 41562 - RNA, 14 nt, Homo sapiens
auaaauuugguucu

SEQ ID NO: 41563 - RNA, 13 nt, Homo sapiens
auaaauuuuccca

SEQ ID NO: 41564 - RNA, 14 nt, Homo sapiens
auaaauuuucccaa

SEQ ID NO: 41565 - RNA, 21 nt, Homo sapiens
auaaauuuucuucuugguucu

SEQ ID NO: 41566 - RNA, 23 nt, Homo sapiens
auaacuggaaacuucagcgguuu

SEQ ID NO: 41567 - RNA, 16 nt, Homo sapiens
auaacuguuauuuaua

SEQ ID NO: 41568 - RNA, 13 nt, Homo sapiens
auaagaauucugu

SEQ ID NO: 41569 - RNA, 15 nt, Homo sapiens
auaagcuguuuuuau

SEQ ID NO: 41570 - RNA, 16 nt, Homo sapiens
auaauaaaauucauuc

SEQ ID NO: 41571 - RNA, 17 nt, Homo sapiens
auaauaaaauucauucc

SEQ ID NO: 41572 - RNA, 19 nt, Homo sapiens
auaauaaaauucauuccau

SEQ ID NO: 41573 - RNA, 17 nt, Homo sapiens
auaauaaagaucaugua

SEQ ID NO: 41574 - RNA, 23 nt, Homo sapiens
auaauagguuugugacuuuccua

SEQ ID NO: 41575 - RNA, 20 nt, Homo sapiens
auaauaugcacacagugcuu

SEQ ID NO: 41576 - RNA, 14 nt, Homo sapiens
auaaucaacugggc

SEQ ID NO: 41577 - RNA, 13 nt, Homo sapiens
auaaucacuuuuu

SEQ ID NO: 41578 - RNA, 21 nt, Homo sapiens
auaaugcgugcauaccacuuu

SEQ ID NO: 41579 - RNA, 22 nt, Homo sapiens
auaaugcgugcauaccacuuuu

SEQ ID NO: 41580 - RNA, 16 nt, Homo sapiens
auaauguagcagcuca

SEQ ID NO: 41581 - RNA, 19 nt, Homo sapiens
auaauuaaggguaugauua

SEQ ID NO: 41582 - RNA, 20 nt, Homo sapiens
auaauuaaggguaugauuaa

SEQ ID NO: 41583 - RNA, 23 nt, Homo sapiens
auaauuccuauauccugugacug

SEQ ID NO: 41584 - RNA, 14 nt, Homo sapiens
auaauuuuuauauu

SEQ ID NO: 41585 - RNA, 18 nt, Homo sapiens
auacaaaaauuagccggg

SEQ ID NO: 41586 - RNA, 20 nt, Homo sapiens
auacaaaaauuagccgggca

SEQ ID NO: 41587 - RNA, 13 nt, Homo sapiens
auacaaucaucaa

SEQ ID NO: 41588 - RNA, 15 nt, Homo sapiens
auacaaucaucaacc

SEQ ID NO: 41589 - RNA, 12 nt, Homo sapiens
auacagugucuu

SEQ ID NO: 41590 - RNA, 21 nt, Homo sapiens
auacauaaacaagaccacguu

SEQ ID NO: 41591 - RNA, 14 nt, Homo sapiens
auacauaaaguaug

SEQ ID NO: 41592 - RNA, 17 nt, Homo sapiens
auacauacuauagauuc

SEQ ID NO: 41593 - RNA, 14 nt, Homo sapiens
auaccuaucaucuu

SEQ ID NO: 41594 - RNA, 21 nt, Homo sapiens
auaccucaacccccauuucua

SEQ ID NO: 41595 - RNA, 19 nt, Homo sapiens
auaccucucuuguagcucu

SEQ ID NO: 41596 - RNA, 18 nt, Homo sapiens
auacgugggcauucaaau

SEQ ID NO: 41597 - RNA, 16 nt, Homo sapiens
auacuauccaguuacu

SEQ ID NO: 41598 - RNA, 13 nt, Homo sapiens
auacuauuuaauu

SEQ ID NO: 41599 - RNA, 20 nt, Homo sapiens
auacuauuuaauuauuucac

SEQ ID NO: 41600 - RNA, 14 nt, Homo sapiens
auacuccuaguaau

SEQ ID NO: 41601 - RNA, 18 nt, Homo sapiens
auacuguauuuuuaccuu

SEQ ID NO: 41602 - RNA, 12 nt, Homo sapiens
auacuguuugag

SEQ ID NO: 41603 - RNA, 12 nt, Homo sapiens
auagaauuaaca

SEQ ID NO: 41604 - RNA, 16 nt, Homo sapiens
auagacaauuuauuau

SEQ ID NO: 41605 - RNA, 21 nt, Homo sapiens
auagcagcuuauucacaagac

SEQ ID NO: 41606 - RNA, 13 nt, Homo sapiens
auagcaucucagg

SEQ ID NO: 41607 - RNA, 23 nt, Homo sapiens
auagccagguaccuucucaccug

SEQ ID NO: 41608 - RNA, 16 nt, Homo sapiens
auagcugacccagccc

SEQ ID NO: 41609 - RNA, 19 nt, Homo sapiens
auaggugcuacaaaaacac

SEQ ID NO: 41610 - RNA, 15 nt, Homo sapiens
auagguuaccaguaa

SEQ ID NO: 41611 - RNA, 16 nt, Homo sapiens
auaguaccucugcuau

SEQ ID NO: 41612 - RNA, 17 nt, Homo sapiens
auaguaccucugcuauu

SEQ ID NO: 41613 - RNA, 15 nt, Homo sapiens
auaguggugugauuu

SEQ ID NO: 41614 - RNA, 10 nt, Homo sapiens
auagugucuu

SEQ ID NO: 41615 - RNA, 14 nt, Homo sapiens
auaguucuacucca

SEQ ID NO: 41616 - RNA, 21 nt, Homo sapiens
auaguucuacuccauuaaaua

SEQ ID NO: 41617 - RNA, 18 nt, Homo sapiens
auaguuuaugauuccacc

SEQ ID NO: 41618 - RNA, 17 nt, Homo sapiens
auauaaauuuucccaaa

SEQ ID NO: 41619 - RNA, 14 nt, Homo sapiens
auauaauaugcaca

SEQ ID NO: 41620 - RNA, 19 nt, Homo sapiens
auauaguuacccaaauuaa

SEQ ID NO: 41621 - RNA, 13 nt, Homo sapiens
auauauacuauau

SEQ ID NO: 41622 - RNA, 17 nt, Homo sapiens
auauaugugaugaucua

SEQ ID NO: 41623 - RNA, 16 nt, Homo sapiens
auauauuuccuuauuc

SEQ ID NO: 41624 - RNA, 19 nt, Homo sapiens
auauauuuccuuauucaga

SEQ ID NO: 41625 - RNA, 12 nt, Homo sapiens
auauauuuuaga

SEQ ID NO: 41626 - RNA, 18 nt, Homo sapiens
auauauuuuuuuuuuuaa

SEQ ID NO: 41627 - RNA, 17 nt, Homo sapiens
auaucacaugucagcca

SEQ ID NO: 41628 - RNA, 18 nt, Homo sapiens
auaucaguccucuuucaa

SEQ ID NO: 41629 - RNA, 17 nt, Homo sapiens
auaucaguuauuuuuaa

SEQ ID NO: 41630 - RNA, 23 nt, Homo sapiens
auaucaugccccuguacuccagc

SEQ ID NO: 41631 - RNA, 14 nt, Homo sapiens
auauccugugacug

SEQ ID NO: 41632 - RNA, 15 nt, Homo sapiens
auauccugugacugu

SEQ ID NO: 41633 - RNA, 15 nt, Homo sapiens
auauccuuagcccau

SEQ ID NO: 41634 - RNA, 16 nt, Homo sapiens
auaucuuaucuuccua

SEQ ID NO: 41635 - RNA, 16 nt, Homo sapiens
auaugacacaucucug

SEQ ID NO: 41636 - RNA, 18 nt, Homo sapiens
auaugaggcauuugcagc

SEQ ID NO: 41637 - RNA, 15 nt, Homo sapiens
auaugauucaaaugu

SEQ ID NO: 41638 - RNA, 14 nt, Homo sapiens
auaugcaaagcacu

SEQ ID NO: 41639 - RNA, 17 nt, Homo sapiens
auaugccugcaaucuga

SEQ ID NO: 41640 - RNA, 15 nt, Homo sapiens
auaugcuauuuauua

SEQ ID NO: 41641 - RNA, 16 nt, Homo sapiens
auaugcuauuuauuaa

SEQ ID NO: 41642 - RNA, 21 nt, Homo sapiens
auaugcuucuguuuuauaauu

SEQ ID NO: 41643 - RNA, 15 nt, Homo sapiens
auauguaacaacaau

SEQ ID NO: 41644 - RNA, 15 nt, Homo sapiens
auauuaaaaucacaa

SEQ ID NO: 41645 - RNA, 24 nt, Homo sapiens
auauuaaaaucacaaacucaucca

SEQ ID NO: 41646 - RNA, 16 nt, Homo sapiens
auauuauguuaaaacu

SEQ ID NO: 41647 - RNA, 19 nt, Homo sapiens
auauuauuuugaauccaga

SEQ ID NO: 41648 - RNA, 23 nt, Homo sapiens
auauucucacagcuccaagaauu

SEQ ID NO: 41649 - RNA, 14 nt, Homo sapiens
auauucucuaguca

SEQ ID NO: 41650 - RNA, 21 nt, Homo sapiens
auauuguugacaacugugacu

SEQ ID NO: 41651 - RNA, 22 nt, Homo sapiens
auauuuauuacuguaagaaaau

SEQ ID NO: 41652 - RNA, 13 nt, Homo sapiens
auauuuauuuuaa

SEQ ID NO: 41653 - RNA, 21 nt, Homo sapiens
auauuucagauaaucacaaua

SEQ ID NO: 41654 - RNA, 22 nt, Homo sapiens
auauuuccaagaaauauuccuu

SEQ ID NO: 41655 - RNA, 23 nt, Homo sapiens
auauuuccuuauucagaauuucu

SEQ ID NO: 41656 - RNA, 13 nt, Homo sapiens
auauuugaaauau

SEQ ID NO: 41657 - RNA, 22 nt, Homo sapiens
auauuuguaucacaaaucuuaa

SEQ ID NO: 41658 - RNA, 15 nt, Homo sapiens
auauuuuauguguaa

SEQ ID NO: 41659 - RNA, 19 nt, Homo sapiens
auauuuuauuauagucacu

SEQ ID NO: 41660 - RNA, 19 nt, Homo sapiens
auauuuugcuuugugauuu

SEQ ID NO: 41661 - RNA, 23 nt, Homo sapiens
auauuuuuuaugaaacauuacag

SEQ ID NO: 41662 - RNA, 21 nt, Homo sapiens
auauuuuuuguuaaaugauuu

SEQ ID NO: 41663 - RNA, 10 nt, Homo sapiens
auauuuuuuu

SEQ ID NO: 41664 - RNA, 18 nt, Homo sapiens
auauuuuuuucugaaauu

SEQ ID NO: 41665 - RNA, 22 nt, Homo sapiens
auauuuuuuucugaaauuuccu

SEQ ID NO: 41666 - RNA, 18 nt, Homo sapiens
auauuuuuuuuuuuaaaa

SEQ ID NO: 41667 - RNA, 13 nt, Homo sapiens
aucaaaagaaaga

SEQ ID NO: 41668 - RNA, 18 nt, Homo sapiens
aucaaauaugcaaagcac

SEQ ID NO: 41669 - RNA, 20 nt, Homo sapiens
aucaaauaugcaaagcacug

SEQ ID NO: 41670 - RNA, 17 nt, Homo sapiens
aucaaauuccagaauga

SEQ ID NO: 41671 - RNA, 14 nt, Homo sapiens
aucaaccaaaugga

SEQ ID NO: 41672 - RNA, 9 nt, Homo sapiens
aucaauauc

SEQ ID NO: 41673 - RNA, 15 nt, Homo sapiens
aucaauccaagaacu

SEQ ID NO: 41674 - RNA, 13 nt, Homo sapiens
aucaaugaaugaa

SEQ ID NO: 41675 - RNA, 23 nt, Homo sapiens
aucaauucuauuacgugcaauac

SEQ ID NO: 41676 - RNA, 16 nt, Homo sapiens
aucacaaacucaucca

SEQ ID NO: 41677 - RNA, 23 nt, Homo sapiens
aucacagcuacuugggaggcuga

SEQ ID NO: 41678 - RNA, 23 nt, Homo sapiens
aucaccaucaauuuuaguuguca

SEQ ID NO: 41679 - RNA, 13 nt, Homo sapiens
aucacccagaaga

SEQ ID NO: 41680 - RNA, 14 nt, Homo sapiens
aucacccagaagaa

SEQ ID NO: 41681 - RNA, 15 nt, Homo sapiens
aucacccagaagaaa

SEQ ID NO: 41682 - RNA, 14 nt, Homo sapiens
aucacucauuuauu

SEQ ID NO: 41683 - RNA, 18 nt, Homo sapiens
aucacucauuuauuucca

SEQ ID NO: 41684 - RNA, 19 nt, Homo sapiens
aucacucauuuauuuccau

SEQ ID NO: 41685 - RNA, 14 nt, Homo sapiens
aucacuugaacccg

SEQ ID NO: 41686 - RNA, 17 nt, Homo sapiens
aucagcauuuuacuacu

SEQ ID NO: 41687 - RNA, 15 nt, Homo sapiens
aucagcuaaguugca

SEQ ID NO: 41688 - RNA, 13 nt, Homo sapiens
aucaggacgagaa

SEQ ID NO: 41689 - RNA, 17 nt, Homo sapiens
aucaguaugaaaauguc

SEQ ID NO: 41690 - RNA, 13 nt, Homo sapiens
aucaguccaaagg

SEQ ID NO: 41691 - RNA, 14 nt, Homo sapiens
aucaguuacucuga

SEQ ID NO: 41692 - RNA, 21 nt, Homo sapiens
aucaguuacucugaagggcau

SEQ ID NO: 41693 - RNA, 16 nt, Homo sapiens
aucaguuauuuuuaaa

SEQ ID NO: 41694 - RNA, 18 nt, Homo sapiens
aucaguuauuuuuaaacu

SEQ ID NO: 41695 - RNA, 23 nt, Homo sapiens
aucauacuucuuaggguuaugau

SEQ ID NO: 41696 - RNA, 14 nt, Homo sapiens
aucauaugggauac

SEQ ID NO: 41697 - RNA, 19 nt, Homo sapiens
aucaugcaaaugcuguauu

SEQ ID NO: 41698 - RNA, 12 nt, Homo sapiens
aucauuuacuuu

SEQ ID NO: 41699 - RNA, 23 nt, Homo sapiens
aucauuuacuuuuaaacuuugau

SEQ ID NO: 41700 - RNA, 18 nt, Homo sapiens
aucauuucugcaucagcu

SEQ ID NO: 41701 - RNA, 13 nt, Homo sapiens
auccaaagcugaa

SEQ ID NO: 41702 - RNA, 19 nt, Homo sapiens
auccaaagcugaauacauu

SEQ ID NO: 41703 - RNA, 19 nt, Homo sapiens
auccaacuuauauuucugc

SEQ ID NO: 41704 - RNA, 21 nt, Homo sapiens
auccaacuuauauuucugcuu

SEQ ID NO: 41705 - RNA, 19 nt, Homo sapiens
auccagauagguuaccagu

SEQ ID NO: 41706 - RNA, 20 nt, Homo sapiens
aucccagcuacuugggaggc

SEQ ID NO: 41707 - RNA, 21 nt, Homo sapiens
aucccagcuacuugggaggcu

SEQ ID NO: 41708 - RNA, 12 nt, Homo sapiens
aucccggccggc

SEQ ID NO: 41709 - RNA, 13 nt, Homo sapiens
aucccggccggcg

SEQ ID NO: 41710 - RNA, 15 nt, Homo sapiens
aucccggccggcgcg

SEQ ID NO: 41711 - RNA, 16 nt, Homo sapiens
aucccggccggcgcgc

SEQ ID NO: 41712 - RNA, 18 nt, Homo sapiens
aucccggccggcgcgcuc

SEQ ID NO: 41713 - RNA, 22 nt, Homo sapiens
aucccggccggcgcgcucaucc

SEQ ID NO: 41714 - RNA, 23 nt, Homo sapiens
aucccggccggcgcgcucauccc

SEQ ID NO: 41715 - RNA, 13 nt, Homo sapiens
aucccuacuguaa

SEQ ID NO: 41716 - RNA, 18 nt, Homo sapiens
auccuaauaaaaagguga

SEQ ID NO: 41717 - RNA, 20 nt, Homo sapiens
auccuaauaaaaaggugacc

SEQ ID NO: 41718 - RNA, 17 nt, Homo sapiens
auccuagucucuaucau

SEQ ID NO: 41719 - RNA, 21 nt, Homo sapiens
auccuagucucuaucauuaaa

SEQ ID NO: 41720 - RNA, 22 nt, Homo sapiens
auccuagucucuaucauuaaag

SEQ ID NO: 41721 - RNA, 17 nt, Homo sapiens
auccuccuccugcuucc

SEQ ID NO: 41722 - RNA, 16 nt, Homo sapiens
auccucucaaccaccu

SEQ ID NO: 41723 - RNA, 15 nt, Homo sapiens
auccucuguguggcu

SEQ ID NO: 41724 - RNA, 14 nt, Homo sapiens
auccugcaauucca

SEQ ID NO: 41725 - RNA, 12 nt, Homo sapiens
auccuggaauau

SEQ ID NO: 41726 - RNA, 17 nt, Homo sapiens
auccugucccuccucca

SEQ ID NO: 41727 - RNA, 17 nt, Homo sapiens
auccugugacugucuca

SEQ ID NO: 41728 - RNA, 14 nt, Homo sapiens
auccugugggaccu

SEQ ID NO: 41729 - RNA, 16 nt, Homo sapiens
auccuucagccugaaa

SEQ ID NO: 41730 - RNA, 13 nt, Homo sapiens
aucgcuuuugaua

SEQ ID NO: 41731 - RNA, 18 nt, Homo sapiens
aucgcuuuugauaaucaa

SEQ ID NO: 41732 - RNA, 20 nt, Homo sapiens
aucgcuuuugauaaucaacu

SEQ ID NO: 41733 - RNA, 20 nt, Homo sapiens
aucgucacugcuuaacuuca

SEQ ID NO: 41734 - RNA, 16 nt, Homo sapiens
aucuaauauauaugaa

SEQ ID NO: 41735 - RNA, 14 nt, Homo sapiens
aucuacacuccagu

SEQ ID NO: 41736 - RNA, 14 nt, Homo sapiens
aucuacuugcacac

SEQ ID NO: 41737 - RNA, 15 nt, Homo sapiens
aucuagauacuguau

SEQ ID NO: 41738 - RNA, 18 nt, Homo sapiens
aucuagauacuguaucau

SEQ ID NO: 41739 - RNA, 13 nt, Homo sapiens
aucuauauuuuac

SEQ ID NO: 41740 - RNA, 19 nt, Homo sapiens
aucuauuuauuaauauuua

SEQ ID NO: 41741 - RNA, 14 nt, Homo sapiens
aucucaaaacugca

SEQ ID NO: 41742 - RNA, 11 nt, Homo sapiens
aucucaauauu

SEQ ID NO: 41743 - RNA, 14 nt, Homo sapiens
aucucaauauuuca

SEQ ID NO: 41744 - RNA, 15 nt, Homo sapiens
aucucacaagcacuu

SEQ ID NO: 41745 - RNA, 16 nt, Homo sapiens
aucucacaagcacuuu

SEQ ID NO: 41746 - RNA, 17 nt, Homo sapiens
aucucacaagcacuuuc

SEQ ID NO: 41747 - RNA, 24 nt, Homo sapiens
aucucaggagauuucaugccuggu

SEQ ID NO: 41748 - RNA, 13 nt, Homo sapiens
aucucauuuaauc

SEQ ID NO: 41749 - RNA, 16 nt, Homo sapiens
aucucauuuaauccuc

SEQ ID NO: 41750 - RNA, 16 nt, Homo sapiens
aucucauuuccaagca

SEQ ID NO: 41751 - RNA, 17 nt, Homo sapiens
aucucauuuccaagcaa

SEQ ID NO: 41752 - RNA, 20 nt, Homo sapiens
aucuccaaaauaaaacuuuu

SEQ ID NO: 41753 - RNA, 19 nt, Homo sapiens
aucuccgucucccaaagug

SEQ ID NO: 41754 - RNA, 22 nt, Homo sapiens
aucucuauuaggaaauauucug

SEQ ID NO: 41755 - RNA, 21 nt, Homo sapiens
aucuguaaaauggagacacca

SEQ ID NO: 41756 - RNA, 13 nt, Homo sapiens
aucuuguaaaggu

SEQ ID NO: 41757 - RNA, 18 nt, Homo sapiens
aucuuuaaaauacacacu

SEQ ID NO: 41758 - RNA, 21 nt, Homo sapiens
aucuuucaaagugucuugaau

SEQ ID NO: 41759 - RNA, 22 nt, Homo sapiens
aucuuuuauacagugucuuaca

SEQ ID NO: 41760 - RNA, 20 nt, Homo sapiens
augaaaacacauuuuucuua

SEQ ID NO: 41761 - RNA, 21 nt, Homo sapiens
augaaaacauagcaucucagg

SEQ ID NO: 41762 - RNA, 22 nt, Homo sapiens
augaaaacauagcaucucagga

SEQ ID NO: 41763 - RNA, 22 nt, Homo sapiens
augaaaagauuaugaucucaga

SEQ ID NO: 41764 - RNA, 14 nt, Homo sapiens
augaaaaugucauu

SEQ ID NO: 41765 - RNA, 14 nt, Homo sapiens
augaaauauuaugu

SEQ ID NO: 41766 - RNA, 21 nt, Homo sapiens
augaagaaguugauaugccuu

SEQ ID NO: 41767 - RNA, 12 nt, Homo sapiens
augaaggggcgg

SEQ ID NO: 41768 - RNA, 13 nt, Homo sapiens
augaaggggcggc

SEQ ID NO: 41769 - RNA, 16 nt, Homo sapiens
augaaggggcggcggc

SEQ ID NO: 41770 - RNA, 16 nt, Homo sapiens
augaaguacucauaca

SEQ ID NO: 41771 - RNA, 14 nt, Homo sapiens
augaaguccaagca

SEQ ID NO: 41772 - RNA, 14 nt, Homo sapiens
augaaugaauggcu

SEQ ID NO: 41773 - RNA, 14 nt, Homo sapiens
augaauguuaaauu

SEQ ID NO: 41774 - RNA, 17 nt, Homo sapiens
augaauuaaguuuuuuu

SEQ ID NO: 41775 - RNA, 19 nt, Homo sapiens
augaauuaaguuuuuuuuu

SEQ ID NO: 41776 - RNA, 20 nt, Homo sapiens
augaauuaaguuuuuuuuua

SEQ ID NO: 41777 - RNA, 21 nt, Homo sapiens
augaauuaaguuuuuuuuuaa

SEQ ID NO: 41778 - RNA, 12 nt, Homo sapiens
augaauuacauu

SEQ ID NO: 41779 - RNA, 15 nt, Homo sapiens
augaauuacauuugu

SEQ ID NO: 41780 - RNA, 15 nt, Homo sapiens
augacacaucucuga

SEQ ID NO: 41781 - RNA, 18 nt, Homo sapiens
augacauaucacauguca

SEQ ID NO: 41782 - RNA, 20 nt, Homo sapiens
augacccccaucccaugggg

SEQ ID NO: 41783 - RNA, 19 nt, Homo sapiens
augacgugacuggccugcu

SEQ ID NO: 41784 - RNA, 20 nt, Homo sapiens
augacgugacuggccugcug

SEQ ID NO: 41785 - RNA, 10 nt, Homo sapiens
augacuaugc

SEQ ID NO: 41786 - RNA, 14 nt, Homo sapiens
augagccggagccc

SEQ ID NO: 41787 - RNA, 17 nt, Homo sapiens
augaggaauauuugcaa

SEQ ID NO: 41788 - RNA, 13 nt, Homo sapiens
augaggcauuugu

SEQ ID NO: 41789 - RNA, 13 nt, Homo sapiens
augauacaaugaa

SEQ ID NO: 41790 - RNA, 14 nt, Homo sapiens
augaucaguaugaa

SEQ ID NO: 41791 - RNA, 17 nt, Homo sapiens
augaucaguaugaaaau

SEQ ID NO: 41792 - RNA, 19 nt, Homo sapiens
augaugaucuuuaaaauac

SEQ ID NO: 41793 - RNA, 14 nt, Homo sapiens
augaugaugaucuu

SEQ ID NO: 41794 - RNA, 20 nt, Homo sapiens
augauguuuagaaacacaac

SEQ ID NO: 41795 - RNA, 11 nt, Homo sapiens
augauuccacc

SEQ ID NO: 41796 - RNA, 19 nt, Homo sapiens
augauuccaccuacaugag

SEQ ID NO: 41797 - RNA, 12 nt, Homo sapiens
augauuucacag

SEQ ID NO: 41798 - RNA, 22 nt, Homo sapiens
augauuucacagugugugguca

SEQ ID NO: 41799 - RNA, 10 nt, Homo sapiens
augauuucau

SEQ ID NO: 41800 - RNA, 14 nt, Homo sapiens
augauuucauucaa

SEQ ID NO: 41801 - RNA, 18 nt, Homo sapiens
augcaaccuuuggaugca

SEQ ID NO: 41802 - RNA, 22 nt, Homo sapiens
augcaaccuuuggaugcacuuu

SEQ ID NO: 41803 - RNA, 15 nt, Homo sapiens
augcaaggucauuuu

SEQ ID NO: 41804 - RNA, 13 nt, Homo sapiens
augcacacagugc

SEQ ID NO: 41805 - RNA, 21 nt, Homo sapiens
augcacagaguuguuacauuu

SEQ ID NO: 41806 - RNA, 19 nt, Homo sapiens
augcacuaaucaauacuuu

SEQ ID NO: 41807 - RNA, 22 nt, Homo sapiens
augcagcccccauuguggucac

SEQ ID NO: 41808 - RNA, 22 nt, Homo sapiens
augcaguguuucccucuguguu

SEQ ID NO: 41809 - RNA, 13 nt, Homo sapiens
augcauacaguaa

SEQ ID NO: 41810 - RNA, 21 nt, Homo sapiens
augcaucuuacugaagguaaa

SEQ ID NO: 41811 - RNA, 23 nt, Homo sapiens
augcaugaaguaauaugcacaca

SEQ ID NO: 41812 - RNA, 12 nt, Homo sapiens
augcauucugag

SEQ ID NO: 41813 - RNA, 18 nt, Homo sapiens
augccccauucaacaucu

SEQ ID NO: 41814 - RNA, 14 nt, Homo sapiens
augccugcaaucug

SEQ ID NO: 41815 - RNA, 11 nt, Homo sapiens
augcucuccaa

SEQ ID NO: 41816 - RNA, 15 nt, Homo sapiens
augcucuccaaacca

SEQ ID NO: 41817 - RNA, 11 nt, Homo sapiens
augcuggccag

SEQ ID NO: 41818 - RNA, 14 nt, Homo sapiens
augcuguauuuuaa

SEQ ID NO: 41819 - RNA, 17 nt, Homo sapiens
augcuguucaugaaaga

SEQ ID NO: 41820 - RNA, 18 nt, Homo sapiens
augcuguucaugaaagau

SEQ ID NO: 41821 - RNA, 16 nt, Homo sapiens
augcuucuguuuuaua

SEQ ID NO: 41822 - RNA, 12 nt, Homo sapiens
augcuuguacau

SEQ ID NO: 41823 - RNA, 13 nt, Homo sapiens
augcuuguacaua

SEQ ID NO: 41824 - RNA, 23 nt, Homo sapiens
augcuuguauuuuacuuuuccau

SEQ ID NO: 41825 - RNA, 13 nt, Homo sapiens
auggaacauaaaa

SEQ ID NO: 41826 - RNA, 23 nt, Homo sapiens
auggaaguugcagugagcugaua

SEQ ID NO: 41827 - RNA, 13 nt, Homo sapiens
auggaauuggagc

SEQ ID NO: 41828 - RNA, 15 nt, Homo sapiens
auggaauuggagcuc

SEQ ID NO: 41829 - RNA, 16 nt, Homo sapiens
auggaauuggagcucg

SEQ ID NO: 41830 - RNA, 13 nt, Homo sapiens
auggagacaccac

SEQ ID NO: 41831 - RNA, 14 nt, Homo sapiens
auggagacaccacc

SEQ ID NO: 41832 - RNA, 17 nt, Homo sapiens
auggagacaccaccacc

SEQ ID NO: 41833 - RNA, 20 nt, Homo sapiens
auggagguuaagcacuuuaa

SEQ ID NO: 41834 - RNA, 14 nt, Homo sapiens
auggcaaacugcca

SEQ ID NO: 41835 - RNA, 17 nt, Homo sapiens
auggcagcuuuccucaa

SEQ ID NO: 41836 - RNA, 18 nt, Homo sapiens
auggcaggaggcauccaa

SEQ ID NO: 41837 - RNA, 13 nt, Homo sapiens
auggcaggcaucg

SEQ ID NO: 41838 - RNA, 13 nt, Homo sapiens
auggcccugccau

SEQ ID NO: 41839 - RNA, 22 nt, Homo sapiens
auggcccugccaugcucuccaa

SEQ ID NO: 41840 - RNA, 18 nt, Homo sapiens
auggcuaguaucaaaaga

SEQ ID NO: 41841 - RNA, 16 nt, Homo sapiens
auggcuauaggugcua

SEQ ID NO: 41842 - RNA, 18 nt, Homo sapiens
auggcuggagcuagaauu

SEQ ID NO: 41843 - RNA, 17 nt, Homo sapiens
auggcuuccuggcaaua

SEQ ID NO: 41844 - RNA, 16 nt, Homo sapiens
auggcuuuugugcauu

SEQ ID NO: 41845 - RNA, 12 nt, Homo sapiens
augggccccaga

SEQ ID NO: 41846 - RNA, 23 nt, Homo sapiens
auggggguaauaagagcaguagc

SEQ ID NO: 41847 - RNA, 20 nt, Homo sapiens
augguggcgcgcaccuguaa

SEQ ID NO: 41848 - RNA, 15 nt, Homo sapiens
augguuccauucucu

SEQ ID NO: 41849 - RNA, 11 nt, Homo sapiens
auguaacaaca

SEQ ID NO: 41850 - RNA, 12 nt, Homo sapiens
auguaacaacaa

SEQ ID NO: 41851 - RNA, 20 nt, Homo sapiens
auguaacaacaauuauuuga

SEQ ID NO: 41852 - RNA, 18 nt, Homo sapiens
auguagaauauauuuccu

SEQ ID NO: 41853 - RNA, 17 nt, Homo sapiens
auguagauaaacucaga

SEQ ID NO: 41854 - RNA, 19 nt, Homo sapiens
auguagauaaacucagaaa

SEQ ID NO: 41855 - RNA, 16 nt, Homo sapiens
auguagauaaagcacu

SEQ ID NO: 41856 - RNA, 23 nt, Homo sapiens
auguagcaaauuccaauacauua

SEQ ID NO: 41857 - RNA, 17 nt, Homo sapiens
auguagcagcucauaaa

SEQ ID NO: 41858 - RNA, 16 nt, Homo sapiens
auguauguaaauagcu

SEQ ID NO: 41859 - RNA, 14 nt, Homo sapiens
auguauguacuuca

SEQ ID NO: 41860 - RNA, 22 nt, Homo sapiens
auguauuacaguggggaaugaa

SEQ ID NO: 41861 - RNA, 19 nt, Homo sapiens
augucagacagaacuugaa

SEQ ID NO: 41862 - RNA, 16 nt, Homo sapiens
augucagccacuguga

SEQ ID NO: 41863 - RNA, 19 nt, Homo sapiens
augucagccacugugauag

SEQ ID NO: 41864 - RNA, 19 nt, Homo sapiens
augucauuugcuggagcuc

SEQ ID NO: 41865 - RNA, 21 nt, Homo sapiens
augugaaacuggauuaaacuu

SEQ ID NO: 41866 - RNA, 17 nt, Homo sapiens
augugaacacaucagcu

SEQ ID NO: 41867 - RNA, 18 nt, Homo sapiens
augugacuuaaugccacu

SEQ ID NO: 41868 - RNA, 20 nt, Homo sapiens
augugacuuggauucaauuu

SEQ ID NO: 41869 - RNA, 14 nt, Homo sapiens
augugaugaucuac

SEQ ID NO: 41870 - RNA, 23 nt, Homo sapiens
auguggagggggcgcgugcaggc

SEQ ID NO: 41871 - RNA, 23 nt, Homo sapiens
auguguaaaauaagguuaugauu

SEQ ID NO: 41872 - RNA, 13 nt, Homo sapiens
auguguaagacaa

SEQ ID NO: 41873 - RNA, 23 nt, Homo sapiens
augugucaggugacccugaugaa

SEQ ID NO: 41874 - RNA, 16 nt, Homo sapiens
auguguggcauuuuca

SEQ ID NO: 41875 - RNA, 15 nt, Homo sapiens
auguguuuuucacau

SEQ ID NO: 41876 - RNA, 14 nt, Homo sapiens
auguuaauauuucu

SEQ ID NO: 41877 - RNA, 19 nt, Homo sapiens
auguuagugcaaauuguca

SEQ ID NO: 41878 - RNA, 13 nt, Homo sapiens
auguuaugcauaa

SEQ ID NO: 41879 - RNA, 21 nt, Homo sapiens
auguuaugcauaaagucagug

SEQ ID NO: 41880 - RNA, 22 nt, Homo sapiens
auguucacuuauugacuauuau

SEQ ID NO: 41881 - RNA, 17 nt, Homo sapiens
auguucuuuggggagcc

SEQ ID NO: 41882 - RNA, 22 nt, Homo sapiens
auguugaaaaaguucugcagau

SEQ ID NO: 41883 - RNA, 19 nt, Homo sapiens
auguuucgcugauauaugu

SEQ ID NO: 41884 - RNA, 12 nt, Homo sapiens
auguuuucacaa

SEQ ID NO: 41885 - RNA, 10 nt, Homo sapiens
auguuuucau

SEQ ID NO: 41886 - RNA, 23 nt, Homo sapiens
auuaaaacucauuuuuguuuuca

SEQ ID NO: 41887 - RNA, 17 nt, Homo sapiens
auuaaaaucacaaacuc

SEQ ID NO: 41888 - RNA, 17 nt, Homo sapiens
auuaaaguucuagugac

SEQ ID NO: 41889 - RNA, 13 nt, Homo sapiens
auuaaauaaaauu

SEQ ID NO: 41890 - RNA, 14 nt, Homo sapiens
auuaaauaaaauuu

SEQ ID NO: 41891 - RNA, 21 nt, Homo sapiens
auuaacuuuuauaaacuuuac

SEQ ID NO: 41892 - RNA, 22 nt, Homo sapiens
auuaaggauuuuaugcuuuaaa

SEQ ID NO: 41893 - RNA, 22 nt, Homo sapiens
auuaaguuuuuuuuuaaaaaag

SEQ ID NO: 41894 - RNA, 11 nt, Homo sapiens
auuaauuugua

SEQ ID NO: 41895 - RNA, 21 nt, Homo sapiens
auuacaaggcuuuaucucagg

SEQ ID NO: 41896 - RNA, 22 nt, Homo sapiens
auuacaaggcuuuaucucaggg

SEQ ID NO: 41897 - RNA, 15 nt, Homo sapiens
auuacaggcgugagc

SEQ ID NO: 41898 - RNA, 13 nt, Homo sapiens
auuacauuuguau

SEQ ID NO: 41899 - RNA, 17 nt, Homo sapiens
auuaccucugauaccuc

SEQ ID NO: 41900 - RNA, 16 nt, Homo sapiens
auuacuguaagaaaau

SEQ ID NO: 41901 - RNA, 18 nt, Homo sapiens
auuagaggucuccaaaau

SEQ ID NO: 41902 - RNA, 12 nt, Homo sapiens
auuagaugacug

SEQ ID NO: 41903 - RNA, 18 nt, Homo sapiens
auuagccgggcauggugg

SEQ ID NO: 41904 - RNA, 13 nt, Homo sapiens
auuagccgggcgu

SEQ ID NO: 41905 - RNA, 14 nt, Homo sapiens
auuagccgggcgug

SEQ ID NO: 41906 - RNA, 12 nt, Homo sapiens
auuaguuuuaua

SEQ ID NO: 41907 - RNA, 16 nt, Homo sapiens
auuauagucacuaguu

SEQ ID NO: 41908 - RNA, 16 nt, Homo sapiens
auuauauauacuauau

SEQ ID NO: 41909 - RNA, 14 nt, Homo sapiens
auuauauucauucu

SEQ ID NO: 41910 - RNA, 10 nt, Homo sapiens
auuauauuua

SEQ ID NO: 41911 - RNA, 23 nt, Homo sapiens
auuaucucaaaacugcacuguca

SEQ ID NO: 41912 - RNA, 15 nt, Homo sapiens
auuaugaauuacauu

SEQ ID NO: 41913 - RNA, 17 nt, Homo sapiens
auuaugaauuacauuug

SEQ ID NO: 41914 - RNA, 19 nt, Homo sapiens
auuaugaauuacauuugua

SEQ ID NO: 41915 - RNA, 18 nt, Homo sapiens
auuauggcugguaacaua

SEQ ID NO: 41916 - RNA, 15 nt, Homo sapiens
auuauucccauucua

SEQ ID NO: 41917 - RNA, 18 nt, Homo sapiens
auuauuggacuuccauuu

SEQ ID NO: 41918 - RNA, 13 nt, Homo sapiens
auuauuuuuacag

SEQ ID NO: 41919 - RNA, 18 nt, Homo sapiens
auucaaacuaauagaauu

SEQ ID NO: 41920 - RNA, 14 nt, Homo sapiens
auucaaaugucuau

SEQ ID NO: 41921 - RNA, 16 nt, Homo sapiens
auucaacaucuaguga

SEQ ID NO: 41922 - RNA, 20 nt, Homo sapiens
auucaaugccccugaauuua

SEQ ID NO: 41923 - RNA, 16 nt, Homo sapiens
auucacaagacccaaa

SEQ ID NO: 41924 - RNA, 17 nt, Homo sapiens
auucacaagacccaaaa

SEQ ID NO: 41925 - RNA, 19 nt, Homo sapiens
auucacaagacccaaaagg

SEQ ID NO: 41926 - RNA, 16 nt, Homo sapiens
auucacagauaccucu

SEQ ID NO: 41927 - RNA, 22 nt, Homo sapiens
auucaccuuccagugucucgga

SEQ ID NO: 41928 - RNA, 22 nt, Homo sapiens
auucagauaugauucaaauguc

SEQ ID NO: 41929 - RNA, 21 nt, Homo sapiens
auucagccccgggaguggcgc

SEQ ID NO: 41930 - RNA, 22 nt, Homo sapiens
auucagccccgggaguggcgcg

SEQ ID NO: 41931 - RNA, 16 nt, Homo sapiens
auucaggaugcccacg

SEQ ID NO: 41932 - RNA, 17 nt, Homo sapiens
auucaggaugcccacgg

SEQ ID NO: 41933 - RNA, 16 nt, Homo sapiens
auucauuaguuuugaa

SEQ ID NO: 41934 - RNA, 21 nt, Homo sapiens
auuccaagccucauguccacu

SEQ ID NO: 41935 - RNA, 17 nt, Homo sapiens
auucccuccugcuacuc

SEQ ID NO: 41936 - RNA, 18 nt, Homo sapiens
auucccuuuugcugccuc

SEQ ID NO: 41937 - RNA, 23 nt, Homo sapiens
auucccuuuugcugccucuaaaa

SEQ ID NO: 41938 - RNA, 19 nt, Homo sapiens
auuccuauauccugugacu

SEQ ID NO: 41939 - RNA, 21 nt, Homo sapiens
auucgcugcaaccuguugaua

SEQ ID NO: 41940 - RNA, 14 nt, Homo sapiens
auucucuccuguac

SEQ ID NO: 41941 - RNA, 19 nt, Homo sapiens
auucucuccuguaccucuu

SEQ ID NO: 41942 - RNA, 16 nt, Homo sapiens
auucucucuccuguac

SEQ ID NO: 41943 - RNA, 17 nt, Homo sapiens
auucugagguaaccuca

SEQ ID NO: 41944 - RNA, 18 nt, Homo sapiens
auucugagguaaccucau

SEQ ID NO: 41945 - RNA, 14 nt, Homo sapiens
auucugcaagcuuu

SEQ ID NO: 41946 - RNA, 15 nt, Homo sapiens
auucugcaagcuuuu

SEQ ID NO: 41947 - RNA, 18 nt, Homo sapiens
auucugccugcccugaaa

SEQ ID NO: 41948 - RNA, 14 nt, Homo sapiens
auucuguuaaucau

SEQ ID NO: 41949 - RNA, 21 nt, Homo sapiens
auucuucuuugguggagauaa

SEQ ID NO: 41950 - RNA, 18 nt, Homo sapiens
auucuuuacccccuggga

SEQ ID NO: 41951 - RNA, 17 nt, Homo sapiens
auugaaaggcauucucu

SEQ ID NO: 41952 - RNA, 21 nt, Homo sapiens
auugaaaggcauucucugaag

SEQ ID NO: 41953 - RNA, 18 nt, Homo sapiens
auugaaguuuuggcaauu

SEQ ID NO: 41954 - RNA, 12 nt, Homo sapiens
auugagcaccug

SEQ ID NO: 41955 - RNA, 14 nt, Homo sapiens
auugagcaccugca

SEQ ID NO: 41956 - RNA, 17 nt, Homo sapiens
auugagcaccugcaggc

SEQ ID NO: 41957 - RNA, 20 nt, Homo sapiens
auugagcaccugcaggcgug

SEQ ID NO: 41958 - RNA, 17 nt, Homo sapiens
auugaggcuuuaaaacu

SEQ ID NO: 41959 - RNA, 19 nt, Homo sapiens
auugaggcuuuaaaacuua

SEQ ID NO: 41960 - RNA, 22 nt, Homo sapiens
auugauguuuucacaaagaaca

SEQ ID NO: 41961 - RNA, 14 nt, Homo sapiens
auugauguuuucau

SEQ ID NO: 41962 - RNA, 21 nt, Homo sapiens
auugccaugagaguucuguca

SEQ ID NO: 41963 - RNA, 17 nt, Homo sapiens
auugcuaucgccaucac

SEQ ID NO: 41964 - RNA, 13 nt, Homo sapiens
auugcugaaugac

SEQ ID NO: 41965 - RNA, 21 nt, Homo sapiens
auugcuuguuagcaaaaugga

SEQ ID NO: 41966 - RNA, 16 nt, Homo sapiens
auuggacuuccauuug

SEQ ID NO: 41967 - RNA, 22 nt, Homo sapiens
auuguaaaauggugugaccacu

SEQ ID NO: 41968 - RNA, 15 nt, Homo sapiens
auuguaacuuaugaa

SEQ ID NO: 41969 - RNA, 16 nt, Homo sapiens
auugucugaaauuuuc

SEQ ID NO: 41970 - RNA, 20 nt, Homo sapiens
auugugccccugcacuccag

SEQ ID NO: 41971 - RNA, 19 nt, Homo sapiens
auuguugacaacugugacu

SEQ ID NO: 41972 - RNA, 23 nt, Homo sapiens
auuguuugcuaagcauuccaacu

SEQ ID NO: 41973 - RNA, 18 nt, Homo sapiens
auuuaaaaaaaaaccuga

SEQ ID NO: 41974 - RNA, 19 nt, Homo sapiens
auuuaacagaaauguacag

SEQ ID NO: 41975 - RNA, 14 nt, Homo sapiens
auuuaagauaugua

SEQ ID NO: 41976 - RNA, 15 nt, Homo sapiens
auuuaagauauguaa

SEQ ID NO: 41977 - RNA, 14 nt, Homo sapiens
auuuaaguuucaca

SEQ ID NO: 41978 - RNA, 21 nt, Homo sapiens
auuuaauaaaugugccuucau

SEQ ID NO: 41979 - RNA, 17 nt, Homo sapiens
auuuaauuugaagauag

SEQ ID NO: 41980 - RNA, 17 nt, Homo sapiens
auuuaccacuuguguuu

SEQ ID NO: 41981 - RNA, 20 nt, Homo sapiens
auuuaguauuuuguuucagu

SEQ ID NO: 41982 - RNA, 14 nt, Homo sapiens
auuuaguuauaaaa

SEQ ID NO: 41983 - RNA, 12 nt, Homo sapiens
auuuauaaucac

SEQ ID NO: 41984 - RNA, 17 nt, Homo sapiens
auuuauaaucacuuuuu

SEQ ID NO: 41985 - RNA, 17 nt, Homo sapiens
auuuauccuuguuaagu

SEQ ID NO: 41986 - RNA, 14 nt, Homo sapiens
auuuauuaccucug

SEQ ID NO: 41987 - RNA, 17 nt, Homo sapiens
auuuauugaaaugauuu

SEQ ID NO: 41988 - RNA, 15 nt, Homo sapiens
auuuauugaggcuuu

SEQ ID NO: 41989 - RNA, 23 nt, Homo sapiens
auuucaaaacucauuuccuaugu

SEQ ID NO: 41990 - RNA, 13 nt, Homo sapiens
auuucacagugug

SEQ ID NO: 41991 - RNA, 23 nt, Homo sapiens
auuucacuugaugauacaaugaa

SEQ ID NO: 41992 - RNA, 13 nt, Homo sapiens
auuucacuuuaga

SEQ ID NO: 41993 - RNA, 18 nt, Homo sapiens
auuucauaccuaucaucu

SEQ ID NO: 41994 - RNA, 20 nt, Homo sapiens
auuucauaccuaucaucuua

SEQ ID NO: 41995 - RNA, 17 nt, Homo sapiens
auuuccaaauucacaag

SEQ ID NO: 41996 - RNA, 21 nt, Homo sapiens
auuuccaagaaauauuccuua

SEQ ID NO: 41997 - RNA, 15 nt, Homo sapiens
auuucuaggacugaa

SEQ ID NO: 41998 - RNA, 16 nt, Homo sapiens
auuucuaggacugaau

SEQ ID NO: 41999 - RNA, 13 nt, Homo sapiens
auuugaagauuua

SEQ ID NO: 42000 - RNA, 14 nt, Homo sapiens
auuugaagauuuaa

SEQ ID NO: 42001 - RNA, 15 nt, Homo sapiens
auuugauaugugaac

SEQ ID NO: 42002 - RNA, 14 nt, Homo sapiens
auuugcaagacaua

SEQ ID NO: 42003 - RNA, 15 nt, Homo sapiens
auuugcaagacauag

SEQ ID NO: 42004 - RNA, 11 nt, Homo sapiens
auuugcacuau

SEQ ID NO: 42005 - RNA, 15 nt, Homo sapiens
auuugcucauggaau

SEQ ID NO: 42006 - RNA, 15 nt, Homo sapiens
auuuggcagugauau

SEQ ID NO: 42007 - RNA, 19 nt, Homo sapiens
auuugguucuaggccgggc

SEQ ID NO: 42008 - RNA, 20 nt, Homo sapiens
auuugguucuaggccgggcg

SEQ ID NO: 42009 - RNA, 18 nt, Homo sapiens
auuuguuaaaauuaucaa

SEQ ID NO: 42010 - RNA, 19 nt, Homo sapiens
auuuguuaaaauuaucaau

SEQ ID NO: 42011 - RNA, 13 nt, Homo sapiens
auuuguuugcaua

SEQ ID NO: 42012 - RNA, 16 nt, Homo sapiens
auuuuaaaagaaugau

SEQ ID NO: 42013 - RNA, 22 nt, Homo sapiens
auuuuaacuuccuuggacucau

SEQ ID NO: 42014 - RNA, 17 nt, Homo sapiens
auuuuaaggcauauuua

SEQ ID NO: 42015 - RNA, 20 nt, Homo sapiens
auuuuaaggcauauuuaaca

SEQ ID NO: 42016 - RNA, 16 nt, Homo sapiens
auuuuaaguaauuuca

SEQ ID NO: 42017 - RNA, 18 nt, Homo sapiens
auuuuaaguaauuucaga

SEQ ID NO: 42018 - RNA, 15 nt, Homo sapiens
auuuuaauaauguuu

SEQ ID NO: 42019 - RNA, 16 nt, Homo sapiens
auuuuaaucaccaagg

SEQ ID NO: 42020 - RNA, 23 nt, Homo sapiens
auuuuaauguuucuuggggaaua

SEQ ID NO: 42021 - RNA, 20 nt, Homo sapiens
auuuuagacauucuuuaucu

SEQ ID NO: 42022 - RNA, 21 nt, Homo sapiens
auuuuagacauucuuuaucuu

SEQ ID NO: 42023 - RNA, 17 nt, Homo sapiens
auuuuagagcaucucau

SEQ ID NO: 42024 - RNA, 22 nt, Homo sapiens
auuuuagggguagcauuugugu

SEQ ID NO: 42025 - RNA, 14 nt, Homo sapiens
auuuuaucugcuau

SEQ ID NO: 42026 - RNA, 13 nt, Homo sapiens
auuuuaugcuuua

SEQ ID NO: 42027 - RNA, 15 nt, Homo sapiens
auuuuauuaugcaug

SEQ ID NO: 42028 - RNA, 15 nt, Homo sapiens
auuuuauuuuauuau

SEQ ID NO: 42029 - RNA, 19 nt, Homo sapiens
auuuucaaaaucaaauucc

SEQ ID NO: 42030 - RNA, 13 nt, Homo sapiens
auuuucacuuuug

SEQ ID NO: 42031 - RNA, 20 nt, Homo sapiens
auuuucacuuuuggcuugua

SEQ ID NO: 42032 - RNA, 16 nt, Homo sapiens
auuuucaugcuguuca

SEQ ID NO: 42033 - RNA, 14 nt, Homo sapiens
auuuuccugaaaac

SEQ ID NO: 42034 - RNA, 19 nt, Homo sapiens
auuuuccuggacaguuuuc

SEQ ID NO: 42035 - RNA, 17 nt, Homo sapiens
auuuugauguuuuaagg

SEQ ID NO: 42036 - RNA, 19 nt, Homo sapiens
auuuuuacaguucucccaa

SEQ ID NO: 42037 - RNA, 17 nt, Homo sapiens
auuuuuagacucaucaa

SEQ ID NO: 42038 - RNA, 15 nt, Homo sapiens
auuuuuaugugcaau

SEQ ID NO: 42039 - RNA, 16 nt, Homo sapiens
auuuuuaugugcaaua

SEQ ID NO: 42040 - RNA, 12 nt, Homo sapiens
auuuuucucaau

SEQ ID NO: 42041 - RNA, 14 nt, Homo sapiens
auuuuugaaaccaa

SEQ ID NO: 42042 - RNA, 21 nt, Homo sapiens
auuuuuuaugaaacauuacag

SEQ ID NO: 42043 - RNA, 16 nt, Homo sapiens
auuuuuuucugaaauu

SEQ ID NO: 42044 - RNA, 21 nt, Homo sapiens
auuuuuuuucuguuauauaaa

SEQ ID NO: 42045 - RNA, 21 nt, Homo sapiens
auuuuuuuuuucaauaaaacu

SEQ ID NO: 42046 - RNA, 24 nt, Homo sapiens
caaaaacacagcaagggugauggg

SEQ ID NO: 42047 - RNA, 19 nt, Homo sapiens
caaaauaccaugccauuua

SEQ ID NO: 42048 - RNA, 17 nt, Homo sapiens
caaaauauagcuuucau

SEQ ID NO: 42049 - RNA, 16 nt, Homo sapiens
caaaauggauaugaca

SEQ ID NO: 42050 - RNA, 16 nt, Homo sapiens
caaaauugggaaagga

SEQ ID NO: 42051 - RNA, 12 nt, Homo sapiens
caaacagaacua

SEQ ID NO: 42052 - RNA, 17 nt, Homo sapiens
caaacagaacuauggaa

SEQ ID NO: 42053 - RNA, 14 nt, Homo sapiens
caaacccggccuga

SEQ ID NO: 42054 - RNA, 13 nt, Homo sapiens
caaacgaaaaaca

SEQ ID NO: 42055 - RNA, 14 nt, Homo sapiens
caaacgaaaaacau

SEQ ID NO: 42056 - RNA, 19 nt, Homo sapiens
caaacugccaucauuuacu

SEQ ID NO: 42057 - RNA, 21 nt, Homo sapiens
caaacugccaucauuuacuuu

SEQ ID NO: 42058 - RNA, 23 nt, Homo sapiens
caaacuuaacaaugacuuguacu

SEQ ID NO: 42059 - RNA, 13 nt, Homo sapiens
caaagaagacaac

SEQ ID NO: 42060 - RNA, 14 nt, Homo sapiens
caaagacaaauucu

SEQ ID NO: 42061 - RNA, 23 nt, Homo sapiens
caaagacugaguacguugugcau

SEQ ID NO: 42062 - RNA, 10 nt, Homo sapiens
caaagauagg

SEQ ID NO: 42063 - RNA, 17 nt, Homo sapiens
caaagcugaauacauuc

SEQ ID NO: 42064 - RNA, 14 nt, Homo sapiens
caaaggcuccugag

SEQ ID NO: 42065 - RNA, 13 nt, Homo sapiens
caaagugcuggga

SEQ ID NO: 42066 - RNA, 23 nt, Homo sapiens
caaauaaguauuuauaauagcaa

SEQ ID NO: 42067 - RNA, 18 nt, Homo sapiens
caaaucuacugucaauuu

SEQ ID NO: 42068 - RNA, 16 nt, Homo sapiens
caaaucuuaacuugaa

SEQ ID NO: 42069 - RNA, 20 nt, Homo sapiens
caaaugagccggagccccuu

SEQ ID NO: 42070 - RNA, 14 nt, Homo sapiens
caaaugcuguauuc

SEQ ID NO: 42071 - RNA, 16 nt, Homo sapiens
caaauguuaugcauaa

SEQ ID NO: 42072 - RNA, 11 nt, Homo sapiens
caaauguucuc

SEQ ID NO: 42073 - RNA, 15 nt, Homo sapiens
caaauuccaauacau

SEQ ID NO: 42074 - RNA, 19 nt, Homo sapiens
caaauucuguuucuugaga

SEQ ID NO: 42075 - RNA, 22 nt, Homo sapiens
caaauugucacaggacagcccu

SEQ ID NO: 42076 - RNA, 14 nt, Homo sapiens
caacaaauaggaau

SEQ ID NO: 42077 - RNA, 22 nt, Homo sapiens
caacacgagcaggcuacuguca

SEQ ID NO: 42078 - RNA, 18 nt, Homo sapiens
caacagaagcuuccauuc

SEQ ID NO: 42079 - RNA, 16 nt, Homo sapiens
caacagauuauuaccu

SEQ ID NO: 42080 - RNA, 17 nt, Homo sapiens
caacaugccagccacug

SEQ ID NO: 42081 - RNA, 18 nt, Homo sapiens
caacaugccagccacugu

SEQ ID NO: 42082 - RNA, 16 nt, Homo sapiens
caacauuaaaacaaua

SEQ ID NO: 42083 - RNA, 13 nt, Homo sapiens
caaccaaauggag

SEQ ID NO: 42084 - RNA, 20 nt, Homo sapiens
caaccaaauggagugacuua

SEQ ID NO: 42085 - RNA, 13 nt, Homo sapiens
caaccuaaauuug

SEQ ID NO: 42086 - RNA, 18 nt, Homo sapiens
caaccucucccaacuaua

SEQ ID NO: 42087 - RNA, 15 nt, Homo sapiens
caaccugggggcuuu

SEQ ID NO: 42088 - RNA, 19 nt, Homo sapiens
caaccugggggcuuuaggg

SEQ ID NO: 42089 - RNA, 17 nt, Homo sapiens
caacuauauuaucaugc

SEQ ID NO: 42090 - RNA, 13 nt, Homo sapiens
caacuauauuguu

SEQ ID NO: 42091 - RNA, 23 nt, Homo sapiens
caacuaucucauuuccaagcaag

SEQ ID NO: 42092 - RNA, 17 nt, Homo sapiens
caacugggguggguggg

SEQ ID NO: 42093 - RNA, 22 nt, Homo sapiens
caacugggguggguggggcagu

SEQ ID NO: 42094 - RNA, 20 nt, Homo sapiens
caacuugaauaauacaccag

SEQ ID NO: 42095 - RNA, 14 nt, Homo sapiens
caagaaauauuccu

SEQ ID NO: 42096 - RNA, 16 nt, Homo sapiens
caagaaaugaaagcag

SEQ ID NO: 42097 - RNA, 22 nt, Homo sapiens
caagaacuuauuuguacauuuu

SEQ ID NO: 42098 - RNA, 11 nt, Homo sapiens
caagaaugaga

SEQ ID NO: 42099 - RNA, 19 nt, Homo sapiens
caagacucugucucaaaaa

SEQ ID NO: 42100 - RNA, 20 nt, Homo sapiens
caagaucuuuuuccagguuc

SEQ ID NO: 42101 - RNA, 18 nt, Homo sapiens
caagaugugggcagugau

SEQ ID NO: 42102 - RNA, 14 nt, Homo sapiens
caagcaaauggcca

SEQ ID NO: 42103 - RNA, 12 nt, Homo sapiens
caagcacuuucc

SEQ ID NO: 42104 - RNA, 22 nt, Homo sapiens
caagcacuuucccucuuggugc

SEQ ID NO: 42105 - RNA, 20 nt, Homo sapiens
caagcauaccaacacgagca

SEQ ID NO: 42106 - RNA, 11 nt, Homo sapiens
caagccagauu

SEQ ID NO: 42107 - RNA, 23 nt, Homo sapiens
caagccagccuugcuccuggcug

SEQ ID NO: 42108 - RNA, 19 nt, Homo sapiens
caagccaucggagcugcua

SEQ ID NO: 42109 - RNA, 12 nt, Homo sapiens
caagccugacca

SEQ ID NO: 42110 - RNA, 16 nt, Homo sapiens
caagccugccucaauc

SEQ ID NO: 42111 - RNA, 19 nt, Homo sapiens
caagcuuuucaaaauugga

SEQ ID NO: 42112 - RNA, 14 nt, Homo sapiens
caaggcccccgggc

SEQ ID NO: 42113 - RNA, 15 nt, Homo sapiens
caaggcccccgggcc

SEQ ID NO: 42114 - RNA, 17 nt, Homo sapiens
caaggcccccgggccga

SEQ ID NO: 42115 - RNA, 13 nt, Homo sapiens
caaggcuggagug

SEQ ID NO: 42116 - RNA, 15 nt, Homo sapiens
caaggcuggagugca

SEQ ID NO: 42117 - RNA, 16 nt, Homo sapiens
caaggcuuagacccuc

SEQ ID NO: 42118 - RNA, 17 nt, Homo sapiens
caaggcuuagacccuca

SEQ ID NO: 42119 - RNA, 15 nt, Homo sapiens
caaggcuuuaucuca

SEQ ID NO: 42120 - RNA, 13 nt, Homo sapiens
caagggaccucuc

SEQ ID NO: 42121 - RNA, 13 nt, Homo sapiens
caagggaccugcu

SEQ ID NO: 42122 - RNA, 14 nt, Homo sapiens
caaggucauuuuuu

SEQ ID NO: 42123 - RNA, 15 nt, Homo sapiens
caaggucauuuuuuu

SEQ ID NO: 42124 - RNA, 21 nt, Homo sapiens
caagguucuucccuuuuacau

SEQ ID NO: 42125 - RNA, 15 nt, Homo sapiens
caagucagucauuca

SEQ ID NO: 42126 - RNA, 17 nt, Homo sapiens
caagugaaaaacaucca

SEQ ID NO: 42127 - RNA, 18 nt, Homo sapiens
caagugaaaaacauccag

SEQ ID NO: 42128 - RNA, 15 nt, Homo sapiens
caagugauccgccca

SEQ ID NO: 42129 - RNA, 17 nt, Homo sapiens
caagugauccgcccauc

SEQ ID NO: 42130 - RNA, 15 nt, Homo sapiens
caaguuaguucaauc

SEQ ID NO: 42131 - RNA, 17 nt, Homo sapiens
caauaaaacuuuuccaa

SEQ ID NO: 42132 - RNA, 19 nt, Homo sapiens
caauaaagcagcguuucua

SEQ ID NO: 42133 - RNA, 22 nt, Homo sapiens
caauaaagcagcguuucuauga

SEQ ID NO: 42134 - RNA, 23 nt, Homo sapiens
caauaucuaauauauaugaauaa

SEQ ID NO: 42135 - RNA, 20 nt, Homo sapiens
caaucacaaaaguauauuca

SEQ ID NO: 42136 - RNA, 21 nt, Homo sapiens
caaucagccuaguugaucagc

SEQ ID NO: 42137 - RNA, 16 nt, Homo sapiens
caaucaguauucauau

SEQ ID NO: 42138 - RNA, 15 nt, Homo sapiens
caaucaucaaccccc

SEQ ID NO: 42139 - RNA, 14 nt, Homo sapiens
caaucaugaauuag

SEQ ID NO: 42140 - RNA, 19 nt, Homo sapiens
caauccugauucauauuua

SEQ ID NO: 42141 - RNA, 15 nt, Homo sapiens
caaucuuaacucauu

SEQ ID NO: 42142 - RNA, 13 nt, Homo sapiens
caaucuucucaga

SEQ ID NO: 42143 - RNA, 16 nt, Homo sapiens
caaugagaucauugug

SEQ ID NO: 42144 - RNA, 17 nt, Homo sapiens
caaugagaucauuguga

SEQ ID NO: 42145 - RNA, 14 nt, Homo sapiens
caaugauaaugcua

SEQ ID NO: 42146 - RNA, 15 nt, Homo sapiens
caaugauaaugcuaa

SEQ ID NO: 42147 - RNA, 16 nt, Homo sapiens
caaugcauucugaggu

SEQ ID NO: 42148 - RNA, 20 nt, Homo sapiens
caaugccccugaauuuaaau

SEQ ID NO: 42149 - RNA, 21 nt, Homo sapiens
caaugccccugaauuuaaaua

SEQ ID NO: 42150 - RNA, 22 nt, Homo sapiens
caauuaaggauuuuaugcuuua

SEQ ID NO: 42151 - RNA, 23 nt, Homo sapiens
caauuauaucaguccucuuucaa

SEQ ID NO: 42152 - RNA, 16 nt, Homo sapiens
caauuauuugaagauu

SEQ ID NO: 42153 - RNA, 18 nt, Homo sapiens
caauuauuugaagauuua

SEQ ID NO: 42154 - RNA, 17 nt, Homo sapiens
caauucaauacagauca

SEQ ID NO: 42155 - RNA, 14 nt, Homo sapiens
caauuccucuggga

SEQ ID NO: 42156 - RNA, 15 nt, Homo sapiens
caauuccucugggaa

SEQ ID NO: 42157 - RNA, 23 nt, Homo sapiens
caauuuaaaaaaaaaccugagcc

SEQ ID NO: 42158 - RNA, 16 nt, Homo sapiens
caauuugaauauaaau

SEQ ID NO: 42159 - RNA, 20 nt, Homo sapiens
caauuuggcagugauauuca

SEQ ID NO: 42160 - RNA, 19 nt, Homo sapiens
caauuuuaaggcauauuua

SEQ ID NO: 42161 - RNA, 15 nt, Homo sapiens
cacaaacucauccau

SEQ ID NO: 42162 - RNA, 18 nt, Homo sapiens
cacaaacucauccauuaa

SEQ ID NO: 42163 - RNA, 14 nt, Homo sapiens
cacaaaucuuaacu

SEQ ID NO: 42164 - RNA, 16 nt, Homo sapiens
cacaaccacucauuca

SEQ ID NO: 42165 - RNA, 17 nt, Homo sapiens
cacaaccacucauucaa

SEQ ID NO: 42166 - RNA, 14 nt, Homo sapiens
cacaaccuguccca

SEQ ID NO: 42167 - RNA, 21 nt, Homo sapiens
cacaacuauauuaucaugcaa

SEQ ID NO: 42168 - RNA, 19 nt, Homo sapiens
cacaagaaaugaaagcagg

SEQ ID NO: 42169 - RNA, 16 nt, Homo sapiens
cacaagacugcacauc

SEQ ID NO: 42170 - RNA, 17 nt, Homo sapiens
cacaagacugcacauca

SEQ ID NO: 42171 - RNA, 12 nt, Homo sapiens
cacaagcacuuu

SEQ ID NO: 42172 - RNA, 22 nt, Homo sapiens
cacaccccagacgaugucuuca

SEQ ID NO: 42173 - RNA, 16 nt, Homo sapiens
cacacuguccuauuau

SEQ ID NO: 42174 - RNA, 13 nt, Homo sapiens
cacacuuuugguu

SEQ ID NO: 42175 - RNA, 17 nt, Homo sapiens
cacagaccuuugaacua

SEQ ID NO: 42176 - RNA, 16 nt, Homo sapiens
cacagauaccucucuu

SEQ ID NO: 42177 - RNA, 21 nt, Homo sapiens
cacagcaagggugaugggaaa

SEQ ID NO: 42178 - RNA, 20 nt, Homo sapiens
cacagcugaacuuguugaga

SEQ ID NO: 42179 - RNA, 23 nt, Homo sapiens
cacagcugaacuuguugagaucc

SEQ ID NO: 42180 - RNA, 11 nt, Homo sapiens
cacaggacagc

SEQ ID NO: 42181 - RNA, 18 nt, Homo sapiens
cacaggcuccaaacugga

SEQ ID NO: 42182 - RNA, 20 nt, Homo sapiens
cacaggcuccaaacuggagc

SEQ ID NO: 42183 - RNA, 14 nt, Homo sapiens
cacaggggacagga

SEQ ID NO: 42184 - RNA, 16 nt, Homo sapiens
cacagucacauuccaa

SEQ ID NO: 42185 - RNA, 15 nt, Homo sapiens
cacagugucuggcac

SEQ ID NO: 42186 - RNA, 18 nt, Homo sapiens
cacaguguguggucaaca

SEQ ID NO: 42187 - RNA, 14 nt, Homo sapiens
cacaguuuugguug

SEQ ID NO: 42188 - RNA, 19 nt, Homo sapiens
cacaguuuugguugcuuua

SEQ ID NO: 42189 - RNA, 17 nt, Homo sapiens
cacaugcaaggucauuu

SEQ ID NO: 42190 - RNA, 23 nt, Homo sapiens
cacauggcuucaccuguccccga

SEQ ID NO: 42191 - RNA, 24 nt, Homo sapiens
cacauggcuucaccuguccccgaa

SEQ ID NO: 42192 - RNA, 22 nt, Homo sapiens
cacaugucagccacugugauag

SEQ ID NO: 42193 - RNA, 21 nt, Homo sapiens
cacauuccugaacaggauauu

SEQ ID NO: 42194 - RNA, 19 nt, Homo sapiens
cacauuggcuauuuaaaga

SEQ ID NO: 42195 - RNA, 17 nt, Homo sapiens
cacauuuuucagauaua

SEQ ID NO: 42196 - RNA, 12 nt, Homo sapiens
caccaaggcuga

SEQ ID NO: 42197 - RNA, 11 nt, Homo sapiens
caccaauauuc

SEQ ID NO: 42198 - RNA, 10 nt, Homo sapiens
caccaccacc

SEQ ID NO: 42199 - RNA, 11 nt, Homo sapiens
caccaccaccc

SEQ ID NO: 42200 - RNA, 13 nt, Homo sapiens
caccaccacccuu

SEQ ID NO: 42201 - RNA, 19 nt, Homo sapiens
caccacccuugccauggag

SEQ ID NO: 42202 - RNA, 14 nt, Homo sapiens
caccacgcccagcu

SEQ ID NO: 42203 - RNA, 16 nt, Homo sapiens
caccagggccuggcug

SEQ ID NO: 42204 - RNA, 17 nt, Homo sapiens
caccagggccuggcugg

SEQ ID NO: 42205 - RNA, 19 nt, Homo sapiens
caccagggccuggcuggga

SEQ ID NO: 42206 - RNA, 23 nt, Homo sapiens
caccagggccuggcugggagugg

SEQ ID NO: 42207 - RNA, 22 nt, Homo sapiens
caccauuccuucugcccugcuu

SEQ ID NO: 42208 - RNA, 12 nt, Homo sapiens
cacccccagaau

SEQ ID NO: 42209 - RNA, 13 nt, Homo sapiens
cacccgcccaccg

SEQ ID NO: 42210 - RNA, 18 nt, Homo sapiens
cacccgcccaccgcaggg

SEQ ID NO: 42211 - RNA, 14 nt, Homo sapiens
cacccuugccaugg

SEQ ID NO: 42212 - RNA, 22 nt, Homo sapiens
cacccuugccauggagguuaag

SEQ ID NO: 42213 - RNA, 17 nt, Homo sapiens
caccgcagggugaacug

SEQ ID NO: 42214 - RNA, 14 nt, Homo sapiens
caccgcuguacgcg

SEQ ID NO: 42215 - RNA, 20 nt, Homo sapiens
caccgcuguacgcgagcgcg

SEQ ID NO: 42216 - RNA, 23 nt, Homo sapiens
caccgcuguacgcgagcgcgcgc

SEQ ID NO: 42217 - RNA, 21 nt, Homo sapiens
caccucagcugccuccccagc

SEQ ID NO: 42218 - RNA, 22 nt, Homo sapiens
caccucagcugccuccccagcu

SEQ ID NO: 42219 - RNA, 17 nt, Homo sapiens
caccucauggaauugga

SEQ ID NO: 42220 - RNA, 12 nt, Homo sapiens
caccucccauuc

SEQ ID NO: 42221 - RNA, 17 nt, Homo sapiens
caccuccugccucaggu

SEQ ID NO: 42222 - RNA, 11 nt, Homo sapiens
caccugcaggc

SEQ ID NO: 42223 - RNA, 14 nt, Homo sapiens
caccugcaggcgug

SEQ ID NO: 42224 - RNA, 15 nt, Homo sapiens
caccugcaggcguga

SEQ ID NO: 42225 - RNA, 17 nt, Homo sapiens
caccugcaggcgugacc

SEQ ID NO: 42226 - RNA, 21 nt, Homo sapiens
caccuggaauauauaaccagu

SEQ ID NO: 42227 - RNA, 13 nt, Homo sapiens
caccuguaauccc

SEQ ID NO: 42228 - RNA, 14 nt, Homo sapiens
caccugugagacca

SEQ ID NO: 42229 - RNA, 13 nt, Homo sapiens
caccugugccguc

SEQ ID NO: 42230 - RNA, 20 nt, Homo sapiens
caccuguuuuuaagcuguuu

SEQ ID NO: 42231 - RNA, 21 nt, Homo sapiens
caccuguuuuuaagcuguuuc

SEQ ID NO: 42232 - RNA, 21 nt, Homo sapiens
caccuuacuucuucucauacu

SEQ ID NO: 42233 - RNA, 18 nt, Homo sapiens
caccuuaucuauguagaa

SEQ ID NO: 42234 - RNA, 19 nt, Homo sapiens
caccuuaucuauguagaau

SEQ ID NO: 42235 - RNA, 14 nt, Homo sapiens
caccuucuggguuc

SEQ ID NO: 42236 - RNA, 21 nt, Homo sapiens
caccuucuggguucaagcgau

SEQ ID NO: 42237 - RNA, 22 nt, Homo sapiens
caccuucuggguucaagcgauu

SEQ ID NO: 42238 - RNA, 16 nt, Homo sapiens
caccuuuuggucugga

SEQ ID NO: 42239 - RNA, 19 nt, Homo sapiens
cacgccuguaaucccagca

SEQ ID NO: 42240 - RNA, 22 nt, Homo sapiens
cacgccuguaaucccagcacuu

SEQ ID NO: 42241 - RNA, 15 nt, Homo sapiens
cacgcucugggucgc

SEQ ID NO: 42242 - RNA, 17 nt, Homo sapiens
cacgcucugggucgccg

SEQ ID NO: 42243 - RNA, 19 nt, Homo sapiens
cacgcucugggucgccggc

SEQ ID NO: 42244 - RNA, 14 nt, Homo sapiens
cacggcuggagcug

SEQ ID NO: 42245 - RNA, 15 nt, Homo sapiens
cacuaaaaaggcaug

SEQ ID NO: 42246 - RNA, 22 nt, Homo sapiens
cacuaaaacaccucagcugccu

SEQ ID NO: 42247 - RNA, 22 nt, Homo sapiens
cacuacagcugagcagauguaa

SEQ ID NO: 42248 - RNA, 14 nt, Homo sapiens
cacuacauucuguu

SEQ ID NO: 42249 - RNA, 20 nt, Homo sapiens
cacuagcuaauaucaauaga

SEQ ID NO: 42250 - RNA, 13 nt, Homo sapiens
cacuagggcaggg

SEQ ID NO: 42251 - RNA, 11 nt, Homo sapiens
cacuaguauuu

SEQ ID NO: 42252 - RNA, 16 nt, Homo sapiens
cacucauuuauuucca

SEQ ID NO: 42253 - RNA, 23 nt, Homo sapiens
cacuccacuuggacaugggcccc

SEQ ID NO: 42254 - RNA, 13 nt, Homo sapiens
cacuccagccuga

SEQ ID NO: 42255 - RNA, 23 nt, Homo sapiens
cacugacuucuaaguaaaaccac

SEQ ID NO: 42256 - RNA, 16 nt, Homo sapiens
cacugcagaagacagu

SEQ ID NO: 42257 - RNA, 16 nt, Homo sapiens
cacugcuuaacuucac

SEQ ID NO: 42258 - RNA, 13 nt, Homo sapiens
cacuggcucccug

SEQ ID NO: 42259 - RNA, 17 nt, Homo sapiens
cacuggcuguuaaucuu

SEQ ID NO: 42260 - RNA, 21 nt, Homo sapiens
cacuggcuguuaaucuuucaa

SEQ ID NO: 42261 - RNA, 18 nt, Homo sapiens
cacuguuaucuucacuuu

SEQ ID NO: 42262 - RNA, 12 nt, Homo sapiens
cacuuacaauuu

SEQ ID NO: 42263 - RNA, 20 nt, Homo sapiens
cacuuauaggaauugaccca

SEQ ID NO: 42264 - RNA, 12 nt, Homo sapiens
cacuucacuuuu

SEQ ID NO: 42265 - RNA, 14 nt, Homo sapiens
cacuuccaagaucu

SEQ ID NO: 42266 - RNA, 14 nt, Homo sapiens
cacuuccucccggc

SEQ ID NO: 42267 - RNA, 15 nt, Homo sapiens
cacuuccucccggcc

SEQ ID NO: 42268 - RNA, 16 nt, Homo sapiens
cacuuccucccggccg

SEQ ID NO: 42269 - RNA, 17 nt, Homo sapiens
cacuuccucccggccgc

SEQ ID NO: 42270 - RNA, 19 nt, Homo sapiens
cacuuccucccggccgcgc

SEQ ID NO: 42271 - RNA, 20 nt, Homo sapiens
cacuuccucccggccgcgcu

SEQ ID NO: 42272 - RNA, 12 nt, Homo sapiens
cacuugaacccg

SEQ ID NO: 42273 - RNA, 15 nt, Homo sapiens
cacuugaacccggga

SEQ ID NO: 42274 - RNA, 15 nt, Homo sapiens
cacuugaugauacaa

SEQ ID NO: 42275 - RNA, 23 nt, Homo sapiens
cacuuggacaugggccccagaua

SEQ ID NO: 42276 - RNA, 13 nt, Homo sapiens
cacuugucaauaa

SEQ ID NO: 42277 - RNA, 20 nt, Homo sapiens
cacuuguguuuugcaagcca

SEQ ID NO: 42278 - RNA, 17 nt, Homo sapiens
cacuuuaacacaguguc

SEQ ID NO: 42279 - RNA, 20 nt, Homo sapiens
cacuuuaacacagugucugg

SEQ ID NO: 42280 - RNA, 15 nt, Homo sapiens
cacuuuagaaagcug

SEQ ID NO: 42281 - RNA, 18 nt, Homo sapiens
cagaaagcagaacaguga

SEQ ID NO: 42282 - RNA, 14 nt, Homo sapiens
cagaaauguguuau

SEQ ID NO: 42283 - RNA, 15 nt, Homo sapiens
cagaaauuguaucuu

SEQ ID NO: 42284 - RNA, 15 nt, Homo sapiens
cagaaauuuaauuca

SEQ ID NO: 42285 - RNA, 11 nt, Homo sapiens
cagaacaguga

SEQ ID NO: 42286 - RNA, 12 nt, Homo sapiens
cagaacagugau

SEQ ID NO: 42287 - RNA, 14 nt, Homo sapiens
cagaacuugaaugu

SEQ ID NO: 42288 - RNA, 21 nt, Homo sapiens
cagaacuugaaugugucaggu

SEQ ID NO: 42289 - RNA, 20 nt, Homo sapiens
cagaagcaacccaaauguuc

SEQ ID NO: 42290 - RNA, 14 nt, Homo sapiens
cagaagucaaggcu

SEQ ID NO: 42291 - RNA, 10 nt, Homo sapiens
cagaauuucu

SEQ ID NO: 42292 - RNA, 19 nt, Homo sapiens
cagacauacuaaccagcag

SEQ ID NO: 42293 - RNA, 21 nt, Homo sapiens
cagaccuuugaacuagaguuu

SEQ ID NO: 42294 - RNA, 15 nt, Homo sapiens
cagacucuggucaag

SEQ ID NO: 42295 - RNA, 16 nt, Homo sapiens
cagagaaaauaaaagc

SEQ ID NO: 42296 - RNA, 18 nt, Homo sapiens
cagagaaaauaaaagcac

SEQ ID NO: 42297 - RNA, 19 nt, Homo sapiens
cagagaaaauaaaagcacu

SEQ ID NO: 42298 - RNA, 20 nt, Homo sapiens
cagagaaaauaaaagcacuu

SEQ ID NO: 42299 - RNA, 16 nt, Homo sapiens
cagagaccaguauucc

SEQ ID NO: 42300 - RNA, 21 nt, Homo sapiens
cagagacgggguuugccaugc

SEQ ID NO: 42301 - RNA, 23 nt, Homo sapiens
cagagacgggguuugccaugcug

SEQ ID NO: 42302 - RNA, 21 nt, Homo sapiens
cagauaaauaguuuaugauuc

SEQ ID NO: 42303 - RNA, 15 nt, Homo sapiens
cagauaugauucaaa

SEQ ID NO: 42304 - RNA, 17 nt, Homo sapiens
cagauauucucuaguca

SEQ ID NO: 42305 - RNA, 16 nt, Homo sapiens
cagaucaagccugccu

SEQ ID NO: 42306 - RNA, 21 nt, Homo sapiens
cagaucaguuuagcaaaucua

SEQ ID NO: 42307 - RNA, 14 nt, Homo sapiens
cagaucauuucaaa

SEQ ID NO: 42308 - RNA, 16 nt, Homo sapiens
cagaucauuucaaaac

SEQ ID NO: 42309 - RNA, 17 nt, Homo sapiens
cagauccuggaaaucag

SEQ ID NO: 42310 - RNA, 17 nt, Homo sapiens
cagcaauaaagcagcgu

SEQ ID NO: 42311 - RNA, 18 nt, Homo sapiens
cagcaauaaagcagcguu

SEQ ID NO: 42312 - RNA, 22 nt, Homo sapiens
cagcaauaaagcagcguuucua

SEQ ID NO: 42313 - RNA, 23 nt, Homo sapiens
cagcacagccucuuagaugcagu

SEQ ID NO: 42314 - RNA, 14 nt, Homo sapiens
cagcacgauuucug

SEQ ID NO: 42315 - RNA, 15 nt, Homo sapiens
cagcacuuacaauuu

SEQ ID NO: 42316 - RNA, 13 nt, Homo sapiens
cagcacuuuggga

SEQ ID NO: 42317 - RNA, 21 nt, Homo sapiens
cagcaguugaaaagacuccaa

SEQ ID NO: 42318 - RNA, 17 nt, Homo sapiens
cagcauuuuacuacuuu

SEQ ID NO: 42319 - RNA, 20 nt, Homo sapiens
cagcauuuuacuacuuuaaa

SEQ ID NO: 42320 - RNA, 12 nt, Homo sapiens
cagccaaccugg

SEQ ID NO: 42321 - RNA, 14 nt, Homo sapiens
cagccaaccugggg

SEQ ID NO: 42322 - RNA, 22 nt, Homo sapiens
cagccacugugauagaggcuga

SEQ ID NO: 42323 - RNA, 15 nt, Homo sapiens
cagccagcacagccu

SEQ ID NO: 42324 - RNA, 16 nt, Homo sapiens
cagccaggcggcugga

SEQ ID NO: 42325 - RNA, 18 nt, Homo sapiens
cagccaggcggcuggaau

SEQ ID NO: 42326 - RNA, 15 nt, Homo sapiens
cagcccaaggguggg

SEQ ID NO: 42327 - RNA, 16 nt, Homo sapiens
cagcccaagggugggu

SEQ ID NO: 42328 - RNA, 15 nt, Homo sapiens
cagccccugggacca

SEQ ID NO: 42329 - RNA, 16 nt, Homo sapiens
cagcccuucuuuccac

SEQ ID NO: 42330 - RNA, 16 nt, Homo sapiens
cagccucagcucucag

SEQ ID NO: 42331 - RNA, 17 nt, Homo sapiens
cagccucagcucucagu

SEQ ID NO: 42332 - RNA, 20 nt, Homo sapiens
cagccucuuagaugcaguuc

SEQ ID NO: 42333 - RNA, 21 nt, Homo sapiens
cagccucuuagaugcaguucu

SEQ ID NO: 42334 - RNA, 14 nt, Homo sapiens
cagccugggugaca

SEQ ID NO: 42335 - RNA, 15 nt, Homo sapiens
cagccugggugacag

SEQ ID NO: 42336 - RNA, 19 nt, Homo sapiens
cagccugggugacagagca

SEQ ID NO: 42337 - RNA, 21 nt, Homo sapiens
cagccuggucaacauggugaa

SEQ ID NO: 42338 - RNA, 19 nt, Homo sapiens
cagccuuggauacuccaug

SEQ ID NO: 42339 - RNA, 17 nt, Homo sapiens
cagcgaguacuucccgc

SEQ ID NO: 42340 - RNA, 23 nt, Homo sapiens
cagcgaguacuucccgcuguucc

SEQ ID NO: 42341 - RNA, 22 nt, Homo sapiens
cagcguuucuaugacacaugca

SEQ ID NO: 42342 - RNA, 13 nt, Homo sapiens
cagcuaaguugca

SEQ ID NO: 42343 - RNA, 13 nt, Homo sapiens
cagcuacuuggga

SEQ ID NO: 42344 - RNA, 18 nt, Homo sapiens
cagcuagaauucacucca

SEQ ID NO: 42345 - RNA, 19 nt, Homo sapiens
cagcuagaauucacuccac

SEQ ID NO: 42346 - RNA, 15 nt, Homo sapiens
cagcucuaaauguca

SEQ ID NO: 42347 - RNA, 23 nt, Homo sapiens
cagcucuaucccaaccucuccca

SEQ ID NO: 42348 - RNA, 15 nt, Homo sapiens
cagcucucaguugca

SEQ ID NO: 42349 - RNA, 18 nt, Homo sapiens
cagcucucaguugcagcc

SEQ ID NO: 42350 - RNA, 14 nt, Homo sapiens
cagcugagcagaug

SEQ ID NO: 42351 - RNA, 15 nt, Homo sapiens
cagcugagcagaugu

SEQ ID NO: 42352 - RNA, 20 nt, Homo sapiens
cagcugagcagauguaauag

SEQ ID NO: 42353 - RNA, 15 nt, Homo sapiens
cagcugccccgggga

SEQ ID NO: 42354 - RNA, 21 nt, Homo sapiens
cagcugccccggggaggggcg

SEQ ID NO: 42355 - RNA, 20 nt, Homo sapiens
cagcugccuccccagcucua

SEQ ID NO: 42356 - RNA, 22 nt, Homo sapiens
cagcugccuccccagcucuauc

SEQ ID NO: 42357 - RNA, 19 nt, Homo sapiens
cagcuguaugauucccagc

SEQ ID NO: 42358 - RNA, 13 nt, Homo sapiens
cagcuuauugucu

SEQ ID NO: 42359 - RNA, 10 nt, Homo sapiens
caggaaaaua

SEQ ID NO: 42360 - RNA, 15 nt, Homo sapiens
caggaaaaucugcac

SEQ ID NO: 42361 - RNA, 23 nt, Homo sapiens
caggaaagagaacuuccagaucc

SEQ ID NO: 42362 - RNA, 18 nt, Homo sapiens
caggaaccacaagacugc

SEQ ID NO: 42363 - RNA, 20 nt, Homo sapiens
caggaaguagaggaggccac

SEQ ID NO: 42364 - RNA, 15 nt, Homo sapiens
caggaccaucccggc

SEQ ID NO: 42365 - RNA, 22 nt, Homo sapiens
caggaccaucccggccggcgcg

SEQ ID NO: 42366 - RNA, 23 nt, Homo sapiens
caggaccaucccggccggcgcgc

SEQ ID NO: 42367 - RNA, 14 nt, Homo sapiens
caggaggcauccaa

SEQ ID NO: 42368 - RNA, 18 nt, Homo sapiens
caggaguuccuaaccagc

SEQ ID NO: 42369 - RNA, 16 nt, Homo sapiens
caggaguuuggccaga

SEQ ID NO: 42370 - RNA, 13 nt, Homo sapiens
caggaugcccacg

SEQ ID NO: 42371 - RNA, 21 nt, Homo sapiens
caggaugcccacggcuggagc

SEQ ID NO: 42372 - RNA, 22 nt, Homo sapiens
caggauggcaggaggcauccaa

SEQ ID NO: 42373 - RNA, 23 nt, Homo sapiens
caggauggcaggaggcauccaaa

SEQ ID NO: 42374 - RNA, 16 nt, Homo sapiens
caggauuuaaguuuca

SEQ ID NO: 42375 - RNA, 14 nt, Homo sapiens
caggcacccccaga

SEQ ID NO: 42376 - RNA, 13 nt, Homo sapiens
caggcaucgccau

SEQ ID NO: 42377 - RNA, 17 nt, Homo sapiens
caggccccaucuggucc

SEQ ID NO: 42378 - RNA, 18 nt, Homo sapiens
caggccccaucugguccu

SEQ ID NO: 42379 - RNA, 15 nt, Homo sapiens
caggcggguccgggu

SEQ ID NO: 42380 - RNA, 22 nt, Homo sapiens
caggcggguccgggucgcagga

SEQ ID NO: 42381 - RNA, 20 nt, Homo sapiens
caggcgugaccugacagccc

SEQ ID NO: 42382 - RNA, 15 nt, Homo sapiens
caggcgugagccacc

SEQ ID NO: 42383 - RNA, 16 nt, Homo sapiens
caggcgugagccacca

SEQ ID NO: 42384 - RNA, 17 nt, Homo sapiens
caggcgugagccaccaa

SEQ ID NO: 42385 - RNA, 18 nt, Homo sapiens
caggcgugagccaccaaa

SEQ ID NO: 42386 - RNA, 23 nt, Homo sapiens
caggcgugagccaccaaacccgg

SEQ ID NO: 42387 - RNA, 17 nt, Homo sapiens
caggcuacugucagcuc

SEQ ID NO: 42388 - RNA, 15 nt, Homo sapiens
caggcuagauguaug

SEQ ID NO: 42389 - RNA, 15 nt, Homo sapiens
caggcuccaaacugg

SEQ ID NO: 42390 - RNA, 18 nt, Homo sapiens
caggcuccaaacuggagc

SEQ ID NO: 42391 - RNA, 22 nt, Homo sapiens
caggcuccaaacuggagcuuga

SEQ ID NO: 42392 - RNA, 13 nt, Homo sapiens
caggcuggcaccg

SEQ ID NO: 42393 - RNA, 14 nt, Homo sapiens
caggcuggcaccgc

SEQ ID NO: 42394 - RNA, 15 nt, Homo sapiens
caggcuggcaccgcu

SEQ ID NO: 42395 - RNA, 20 nt, Homo sapiens
caggcuggcaccgcuguacg

SEQ ID NO: 42396 - RNA, 14 nt, Homo sapiens
caggcuggucucga

SEQ ID NO: 42397 - RNA, 24 nt, Homo sapiens
caggcuggucucgaacugcuggau

SEQ ID NO: 42398 - RNA, 17 nt, Homo sapiens
cagggaaagggucuccc

SEQ ID NO: 42399 - RNA, 18 nt, Homo sapiens
cagggaaauguaugugug

SEQ ID NO: 42400 - RNA, 13 nt, Homo sapiens
cagggagccccuu

SEQ ID NO: 42401 - RNA, 15 nt, Homo sapiens
cagggccuggcuggg

SEQ ID NO: 42402 - RNA, 18 nt, Homo sapiens
cagggccuggcugggagu

SEQ ID NO: 42403 - RNA, 20 nt, Homo sapiens
cagggccuggcugggagugg

SEQ ID NO: 42404 - RNA, 16 nt, Homo sapiens
cagggcuacgcgcgcu

SEQ ID NO: 42405 - RNA, 20 nt, Homo sapiens
cagggcuacgcgcgcuccgc

SEQ ID NO: 42406 - RNA, 17 nt, Homo sapiens
cagggugaacugcagcg

SEQ ID NO: 42407 - RNA, 22 nt, Homo sapiens
cagggugaacugcagcgaguac

SEQ ID NO: 42408 - RNA, 23 nt, Homo sapiens
caggguuaguauuguccaggucu

SEQ ID NO: 42409 - RNA, 12 nt, Homo sapiens
caggucacacaa

SEQ ID NO: 42410 - RNA, 11 nt, Homo sapiens
caggucuacca

SEQ ID NO: 42411 - RNA, 19 nt, Homo sapiens
caggugccaguuauggcua

SEQ ID NO: 42412 - RNA, 22 nt, Homo sapiens
caguaacggaacaguauccagu

SEQ ID NO: 42413 - RNA, 12 nt, Homo sapiens
caguaacugaca

SEQ ID NO: 42414 - RNA, 20 nt, Homo sapiens
caguaguuagcuuucuuccu

SEQ ID NO: 42415 - RNA, 15 nt, Homo sapiens
caguauccaguacuc

SEQ ID NO: 42416 - RNA, 17 nt, Homo sapiens
caguaugaaaaugucau

SEQ ID NO: 42417 - RNA, 21 nt, Homo sapiens
caguaugaaaaugucauuguu

SEQ ID NO: 42418 - RNA, 17 nt, Homo sapiens
cagucacauuccaagcc

SEQ ID NO: 42419 - RNA, 16 nt, Homo sapiens
cagucaccucauggaa

SEQ ID NO: 42420 - RNA, 17 nt, Homo sapiens
cagucauucagauauga

SEQ ID NO: 42421 - RNA, 17 nt, Homo sapiens
cagucugacuguuucca

SEQ ID NO: 42422 - RNA, 19 nt, Homo sapiens
cagucugacuguuuccauc

SEQ ID NO: 42423 - RNA, 17 nt, Homo sapiens
cagugagaucaauguga

SEQ ID NO: 42424 - RNA, 15 nt, Homo sapiens
cagugagccgagauu

SEQ ID NO: 42425 - RNA, 16 nt, Homo sapiens
cagugagccgagauug

SEQ ID NO: 42426 - RNA, 18 nt, Homo sapiens
cagugaggcggauugaga

SEQ ID NO: 42427 - RNA, 23 nt, Homo sapiens
cagugaucaaguuauuuuuaauu

SEQ ID NO: 42428 - RNA, 16 nt, Homo sapiens
cagugauuaccaggga

SEQ ID NO: 42429 - RNA, 12 nt, Homo sapiens
cagugcuuggcc

SEQ ID NO: 42430 - RNA, 17 nt, Homo sapiens
cagugcuuggcccagga

SEQ ID NO: 42431 - RNA, 18 nt, Homo sapiens
cagugcuuggcccaggag

SEQ ID NO: 42432 - RNA, 23 nt, Homo sapiens
cagugcuuuccguggcacugcau

SEQ ID NO: 42433 - RNA, 13 nt, Homo sapiens
caguguacagucu

SEQ ID NO: 42434 - RNA, 14 nt, Homo sapiens
caguguacagucuu

SEQ ID NO: 42435 - RNA, 17 nt, Homo sapiens
cagugucaaugcagccc

SEQ ID NO: 42436 - RNA, 22 nt, Homo sapiens
cagugucaaugcagcccccauu

SEQ ID NO: 42437 - RNA, 17 nt, Homo sapiens
caguguccucaucugua

SEQ ID NO: 42438 - RNA, 22 nt, Homo sapiens
cagugucuggcacuugggacaa

SEQ ID NO: 42439 - RNA, 23 nt, Homo sapiens
caguuacucugaagggcaucaug

SEQ ID NO: 42440 - RNA, 20 nt, Homo sapiens
caguuauuuuuaaacuguaa

SEQ ID NO: 42441 - RNA, 18 nt, Homo sapiens
caguuccugagaccagcc

SEQ ID NO: 42442 - RNA, 19 nt, Homo sapiens
caguuccugagaccagcca

SEQ ID NO: 42443 - RNA, 20 nt, Homo sapiens
caguuccugagaccagccaa

SEQ ID NO: 42444 - RNA, 21 nt, Homo sapiens
caguuccugagaccagccaac

SEQ ID NO: 42445 - RNA, 22 nt, Homo sapiens
caguuccugagaccagccaacc

SEQ ID NO: 42446 - RNA, 23 nt, Homo sapiens
caguuccugagaccagccaaccu

SEQ ID NO: 42447 - RNA, 15 nt, Homo sapiens
caguucugaagaaga

SEQ ID NO: 42448 - RNA, 13 nt, Homo sapiens
caguugaaaagac

SEQ ID NO: 42449 - RNA, 22 nt, Homo sapiens
caguuguuauuuauugaaauga

SEQ ID NO: 42450 - RNA, 20 nt, Homo sapiens
cauaaacaagaccacguuuc

SEQ ID NO: 42451 - RNA, 21 nt, Homo sapiens
cauaaacaagaccacguuucu

SEQ ID NO: 42452 - RNA, 22 nt, Homo sapiens
cauaaauuagaggucuccaaaa

SEQ ID NO: 42453 - RNA, 17 nt, Homo sapiens
cauaaauuuaguauuuu

SEQ ID NO: 42454 - RNA, 18 nt, Homo sapiens
cauaaccccggaagccaa

SEQ ID NO: 42455 - RNA, 18 nt, Homo sapiens
cauaagcaaagacuauga

SEQ ID NO: 42456 - RNA, 16 nt, Homo sapiens
cauaauuacuauguca

SEQ ID NO: 42457 - RNA, 13 nt, Homo sapiens
cauacauguuaca

SEQ ID NO: 42458 - RNA, 13 nt, Homo sapiens
cauacauuugugu

SEQ ID NO: 42459 - RNA, 13 nt, Homo sapiens
cauacuaaccagc

SEQ ID NO: 42460 - RNA, 13 nt, Homo sapiens
cauagagacuuug

SEQ ID NO: 42461 - RNA, 20 nt, Homo sapiens
cauagauucccugagcagga

SEQ ID NO: 42462 - RNA, 20 nt, Homo sapiens
cauagcagauuuuaauuuug

SEQ ID NO: 42463 - RNA, 14 nt, Homo sapiens
cauagggugacaca

SEQ ID NO: 42464 - RNA, 17 nt, Homo sapiens
cauaguaccucugcuau

SEQ ID NO: 42465 - RNA, 20 nt, Homo sapiens
cauauccuuagcccaucuuu

SEQ ID NO: 42466 - RNA, 20 nt, Homo sapiens
cauauguuuuuguaaguuua

SEQ ID NO: 42467 - RNA, 11 nt, Homo sapiens
cauauuaaaau

SEQ ID NO: 42468 - RNA, 16 nt, Homo sapiens
cauauuaccacagaca

SEQ ID NO: 42469 - RNA, 18 nt, Homo sapiens
cauauugaugugugucua

SEQ ID NO: 42470 - RNA, 14 nt, Homo sapiens
cauauuuaacaaaa

SEQ ID NO: 42471 - RNA, 16 nt, Homo sapiens
cauauuuuauuauagu

SEQ ID NO: 42472 - RNA, 19 nt, Homo sapiens
cauauuuuauuauagucac

SEQ ID NO: 42473 - RNA, 19 nt, Homo sapiens
caucaaggguacacugccu

SEQ ID NO: 42474 - RNA, 21 nt, Homo sapiens
caucaaggguacacugccuuc

SEQ ID NO: 42475 - RNA, 14 nt, Homo sapiens
caucaaugaaugaa

SEQ ID NO: 42476 - RNA, 15 nt, Homo sapiens
caucaaugaaugaau

SEQ ID NO: 42477 - RNA, 18 nt, Homo sapiens
caucaaugaaugaaugaa

SEQ ID NO: 42478 - RNA, 13 nt, Homo sapiens
caucacaguuuug

SEQ ID NO: 42479 - RNA, 14 nt, Homo sapiens
caucagcacgauuu

SEQ ID NO: 42480 - RNA, 18 nt, Homo sapiens
caucagcacgauuucugu

SEQ ID NO: 42481 - RNA, 24 nt, Homo sapiens
caucagcacgauuucuguuuagau

SEQ ID NO: 42482 - RNA, 18 nt, Homo sapiens
caucaguauugaagcauu

SEQ ID NO: 42483 - RNA, 13 nt, Homo sapiens
cauccacuuucca

SEQ ID NO: 42484 - RNA, 15 nt, Homo sapiens
cauccagauagguua

SEQ ID NO: 42485 - RNA, 18 nt, Homo sapiens
caucccggccggcgcgcu

SEQ ID NO: 42486 - RNA, 22 nt, Homo sapiens
caucccggccggcgcgcucauc

SEQ ID NO: 42487 - RNA, 17 nt, Homo sapiens
cauccuagucucuauca

SEQ ID NO: 42488 - RNA, 22 nt, Homo sapiens
cauccuagucucuaucauuaaa

SEQ ID NO: 42489 - RNA, 19 nt, Homo sapiens
cauccugccccugagccca

SEQ ID NO: 42490 - RNA, 22 nt, Homo sapiens
cauccugccccugagcccaugg

SEQ ID NO: 42491 - RNA, 16 nt, Homo sapiens
cauccugugggaccug

SEQ ID NO: 42492 - RNA, 11 nt, Homo sapiens
caucucugcaa

SEQ ID NO: 42493 - RNA, 15 nt, Homo sapiens
caucuguaaaaugga

SEQ ID NO: 42494 - RNA, 16 nt, Homo sapiens
caucuguaaaauggag

SEQ ID NO: 42495 - RNA, 12 nt, Homo sapiens
caucuucuuuca

SEQ ID NO: 42496 - RNA, 19 nt, Homo sapiens
caucuuggucacauacaau

SEQ ID NO: 42497 - RNA, 18 nt, Homo sapiens
caucuuucaagggaccuc

SEQ ID NO: 42498 - RNA, 19 nt, Homo sapiens
caucuuucaagggaccucu

SEQ ID NO: 42499 - RNA, 21 nt, Homo sapiens
caucuuucaagggaccucucc

SEQ ID NO: 42500 - RNA, 23 nt, Homo sapiens
caucuuucaagggaccucuccau

SEQ ID NO: 42501 - RNA, 12 nt, Homo sapiens
caucuuucacau

SEQ ID NO: 42502 - RNA, 16 nt, Homo sapiens
caugaaaacacauuuu

SEQ ID NO: 42503 - RNA, 13 nt, Homo sapiens
caugaaagcguaa

SEQ ID NO: 42504 - RNA, 16 nt, Homo sapiens
caugaaggggcggcgg

SEQ ID NO: 42505 - RNA, 17 nt, Homo sapiens
caugaaggggcggcggc

SEQ ID NO: 42506 - RNA, 18 nt, Homo sapiens
caugaaggggcggcggcc

SEQ ID NO: 42507 - RNA, 20 nt, Homo sapiens
caugaaggggcggcggcccu

SEQ ID NO: 42508 - RNA, 21 nt, Homo sapiens
caugaaggggcggcggcccug

SEQ ID NO: 42509 - RNA, 19 nt, Homo sapiens
caugaaguaauaugcacac

SEQ ID NO: 42510 - RNA, 15 nt, Homo sapiens
caugaaguccaagca

SEQ ID NO: 42511 - RNA, 17 nt, Homo sapiens
caugaauuaguuuuaua

SEQ ID NO: 42512 - RNA, 19 nt, Homo sapiens
caugagagacagcaggucu

SEQ ID NO: 42513 - RNA, 12 nt, Homo sapiens
caugagccuuug

SEQ ID NO: 42514 - RNA, 16 nt, Homo sapiens
caugaucccaccuccc

SEQ ID NO: 42515 - RNA, 20 nt, Homo sapiens
caugauccugcaauuccacu

SEQ ID NO: 42516 - RNA, 20 nt, Homo sapiens
caugaugcugagcccggaaa

SEQ ID NO: 42517 - RNA, 21 nt, Homo sapiens
caugauguuuagaaacacaac

SEQ ID NO: 42518 - RNA, 16 nt, Homo sapiens
caugcaaggucauuuu

SEQ ID NO: 42519 - RNA, 21 nt, Homo sapiens
caugcucuccaaaccacuuuu

SEQ ID NO: 42520 - RNA, 13 nt, Homo sapiens
caugcugccaaua

SEQ ID NO: 42521 - RNA, 15 nt, Homo sapiens
caugcugccaauauc

SEQ ID NO: 42522 - RNA, 19 nt, Homo sapiens
caugcugccaauauccuaa

SEQ ID NO: 42523 - RNA, 13 nt, Homo sapiens
caugcuggccagg

SEQ ID NO: 42524 - RNA, 15 nt, Homo sapiens
caugcugucuacacu

SEQ ID NO: 42525 - RNA, 16 nt, Homo sapiens
caugcugucuacacua

SEQ ID NO: 42526 - RNA, 16 nt, Homo sapiens
cauggaauuggagcuc

SEQ ID NO: 42527 - RNA, 15 nt, Homo sapiens
cauggaucugguagg

SEQ ID NO: 42528 - RNA, 22 nt, Homo sapiens
cauggaucugguagggggaaaa

SEQ ID NO: 42529 - RNA, 19 nt, Homo sapiens
cauggcacucuauguucua

SEQ ID NO: 42530 - RNA, 14 nt, Homo sapiens
cauggcccugccau

SEQ ID NO: 42531 - RNA, 23 nt, Homo sapiens
cauggcuggagcuagaauuugau

SEQ ID NO: 42532 - RNA, 14 nt, Homo sapiens
caugggcacugugg

SEQ ID NO: 42533 - RNA, 23 nt, Homo sapiens
caugggccuagcccacuggcucc

SEQ ID NO: 42534 - RNA, 18 nt, Homo sapiens
caugguggcgcgcaccug

SEQ ID NO: 42535 - RNA, 15 nt, Homo sapiens
cauggugugcuggcu

SEQ ID NO: 42536 - RNA, 17 nt, Homo sapiens
cauggugugcuggcuua

SEQ ID NO: 42537 - RNA, 12 nt, Homo sapiens
cauguacaucca

SEQ ID NO: 42538 - RNA, 16 nt, Homo sapiens
cauguauuuguuugca

SEQ ID NO: 42539 - RNA, 19 nt, Homo sapiens
caugucagccacugugaua

SEQ ID NO: 42540 - RNA, 18 nt, Homo sapiens
caugugauuacccucugg

SEQ ID NO: 42541 - RNA, 19 nt, Homo sapiens
caugugauuacccucuggg

SEQ ID NO: 42542 - RNA, 11 nt, Homo sapiens
cauguuuucuu

SEQ ID NO: 42543 - RNA, 13 nt, Homo sapiens
cauuaaaguucua

SEQ ID NO: 42544 - RNA, 20 nt, Homo sapiens
cauuaaaguucuagugaccg

SEQ ID NO: 42545 - RNA, 20 nt, Homo sapiens
cauuaaauauaauaugcaca

SEQ ID NO: 42546 - RNA, 20 nt, Homo sapiens
cauuaauaauaaauucccug

SEQ ID NO: 42547 - RNA, 14 nt, Homo sapiens
cauuaguuuugaag

SEQ ID NO: 42548 - RNA, 15 nt, Homo sapiens
cauuaguuuugaaga

SEQ ID NO: 42549 - RNA, 18 nt, Homo sapiens
cauuauauuuauuacugu

SEQ ID NO: 42550 - RNA, 22 nt, Homo sapiens
cauuaucucaaaacugcacugu

SEQ ID NO: 42551 - RNA, 17 nt, Homo sapiens
cauuauuggacuuccau

SEQ ID NO: 42552 - RNA, 21 nt, Homo sapiens
cauuauuggacuuccauuugg

SEQ ID NO: 42553 - RNA, 16 nt, Homo sapiens
cauucacagauaccuc

SEQ ID NO: 42554 - RNA, 19 nt, Homo sapiens
cauucacagauaccucucu

SEQ ID NO: 42555 - RNA, 23 nt, Homo sapiens
cauucacagauaccucucuugua

SEQ ID NO: 42556 - RNA, 14 nt, Homo sapiens
cauucaggaugccc

SEQ ID NO: 42557 - RNA, 21 nt, Homo sapiens
cauucccguggaacguuuuuc

SEQ ID NO: 42558 - RNA, 17 nt, Homo sapiens
cauucuccuuguguuac

SEQ ID NO: 42559 - RNA, 18 nt, Homo sapiens
cauucuugaaagcugugg

SEQ ID NO: 42560 - RNA, 13 nt, Homo sapiens
cauucuuuuugaa

SEQ ID NO: 42561 - RNA, 20 nt, Homo sapiens
cauucuuuuugaaaugucaa

SEQ ID NO: 42562 - RNA, 15 nt, Homo sapiens
cauugagaacugcau

SEQ ID NO: 42563 - RNA, 23 nt, Homo sapiens
cauugagaacugcauauguuucg

SEQ ID NO: 42564 - RNA, 19 nt, Homo sapiens
cauuguaauugcuaucgcc

SEQ ID NO: 42565 - RNA, 16 nt, Homo sapiens
cauuguggucacagga

SEQ ID NO: 42566 - RNA, 20 nt, Homo sapiens
cauuguucuugugaacccaa

SEQ ID NO: 42567 - RNA, 15 nt, Homo sapiens
cauuuaaaauauuuu

SEQ ID NO: 42568 - RNA, 11 nt, Homo sapiens
cauuuaauuua

SEQ ID NO: 42569 - RNA, 22 nt, Homo sapiens
cauuuauaauguagcagcucau

SEQ ID NO: 42570 - RNA, 14 nt, Homo sapiens
cauuuccaaauuca

SEQ ID NO: 42571 - RNA, 17 nt, Homo sapiens
cauuuccaaauucacaa

SEQ ID NO: 42572 - RNA, 21 nt, Homo sapiens
cauuucuauuuauuuacugag

SEQ ID NO: 42573 - RNA, 17 nt, Homo sapiens
cauuugaaaauuuugau

SEQ ID NO: 42574 - RNA, 19 nt, Homo sapiens
cauuugcgaaugguuccau

SEQ ID NO: 42575 - RNA, 20 nt, Homo sapiens
cauuugcgaaugguuccauu

SEQ ID NO: 42576 - RNA, 19 nt, Homo sapiens
cauuugcuggagcucugcc

SEQ ID NO: 42577 - RNA, 11 nt, Homo sapiens
cauuugguaag

SEQ ID NO: 42578 - RNA, 14 nt, Homo sapiens
cauuuguauaaaau

SEQ ID NO: 42579 - RNA, 17 nt, Homo sapiens
cauuuguuaauauuucu

SEQ ID NO: 42580 - RNA, 19 nt, Homo sapiens
cauuuguuaauauuucuuc

SEQ ID NO: 42581 - RNA, 12 nt, Homo sapiens
cauuuguuugaa

SEQ ID NO: 42582 - RNA, 22 nt, Homo sapiens
cauuuuauaaaucgcuuuugau

SEQ ID NO: 42583 - RNA, 12 nt, Homo sapiens
cauuuucacuuu

SEQ ID NO: 42584 - RNA, 15 nt, Homo sapiens
cauuuuuuaaaugca

SEQ ID NO: 42585 - RNA, 18 nt, Homo sapiens
ccaaacuggagcuugaaa

SEQ ID NO: 42586 - RNA, 13 nt, Homo sapiens
ccaaagugcuggg

SEQ ID NO: 42587 - RNA, 21 nt, Homo sapiens
ccaaagugugacucauuaaau

SEQ ID NO: 42588 - RNA, 20 nt, Homo sapiens
ccaaauucacaaguuguguu

SEQ ID NO: 42589 - RNA, 16 nt, Homo sapiens
ccaaauuuguauuuaa

SEQ ID NO: 42590 - RNA, 14 nt, Homo sapiens
ccaacacgagcagg

SEQ ID NO: 42591 - RNA, 21 nt, Homo sapiens
ccaacagaagcuuccauucca

SEQ ID NO: 42592 - RNA, 16 nt, Homo sapiens
ccaacagcuccaccuu

SEQ ID NO: 42593 - RNA, 18 nt, Homo sapiens
ccaaccuaagcaagaucc

SEQ ID NO: 42594 - RNA, 21 nt, Homo sapiens
ccaacugggguggguggggca

SEQ ID NO: 42595 - RNA, 23 nt, Homo sapiens
ccaacugggguggguggggcagu

SEQ ID NO: 42596 - RNA, 20 nt, Homo sapiens
ccaacuuugaagucugauuu

SEQ ID NO: 42597 - RNA, 19 nt, Homo sapiens
ccaagaaaauggccaguga

SEQ ID NO: 42598 - RNA, 18 nt, Homo sapiens
ccaagaagauaaucucca

SEQ ID NO: 42599 - RNA, 20 nt, Homo sapiens
ccaagaagauaaucuccaaa

SEQ ID NO: 42600 - RNA, 21 nt, Homo sapiens
ccaagaagauaaucuccaaag

SEQ ID NO: 42601 - RNA, 11 nt, Homo sapiens
ccaagcaaaug

SEQ ID NO: 42602 - RNA, 13 nt, Homo sapiens
ccaagccugacca

SEQ ID NO: 42603 - RNA, 17 nt, Homo sapiens
ccaaggcccccgggccg

SEQ ID NO: 42604 - RNA, 19 nt, Homo sapiens
ccaaggcccccgggccgac

SEQ ID NO: 42605 - RNA, 21 nt, Homo sapiens
ccaaggcccccgggccgacgg

SEQ ID NO: 42606 - RNA, 14 nt, Homo sapiens
ccaaggcuggagug

SEQ ID NO: 42607 - RNA, 18 nt, Homo sapiens
ccaaggcuggagugcagu

SEQ ID NO: 42608 - RNA, 22 nt, Homo sapiens
ccaaggcuggagugcaguggcg

SEQ ID NO: 42609 - RNA, 21 nt, Homo sapiens
ccaaguucuuaguugcuguau

SEQ ID NO: 42610 - RNA, 16 nt, Homo sapiens
ccaaguuuauauacaa

SEQ ID NO: 42611 - RNA, 19 nt, Homo sapiens
ccaaguuuauauacaauua

SEQ ID NO: 42612 - RNA, 23 nt, Homo sapiens
ccaauacauuauuggacuuccau

SEQ ID NO: 42613 - RNA, 20 nt, Homo sapiens
ccaaugagaucauugugaag

SEQ ID NO: 42614 - RNA, 14 nt, Homo sapiens
ccaauuuacuuugu

SEQ ID NO: 42615 - RNA, 15 nt, Homo sapiens
ccaauuuacuuuguu

SEQ ID NO: 42616 - RNA, 20 nt, Homo sapiens
ccacaacuauauuaucaugc

SEQ ID NO: 42617 - RNA, 21 nt, Homo sapiens
ccacaccagggccuggcuggg

SEQ ID NO: 42618 - RNA, 12 nt, Homo sapiens
ccacagcaguug

SEQ ID NO: 42619 - RNA, 23 nt, Homo sapiens
ccacagcaguugaaaagacucca

SEQ ID NO: 42620 - RNA, 10 nt, Homo sapiens
ccacagcugu

SEQ ID NO: 42621 - RNA, 15 nt, Homo sapiens
ccacagcuguaugau

SEQ ID NO: 42622 - RNA, 22 nt, Homo sapiens
ccacagcuguaugauucccagc

SEQ ID NO: 42623 - RNA, 18 nt, Homo sapiens
ccacauccugugggaccu

SEQ ID NO: 42624 - RNA, 15 nt, Homo sapiens
ccacauggcuucacc

SEQ ID NO: 42625 - RNA, 17 nt, Homo sapiens
ccaccaaacccggccug

SEQ ID NO: 42626 - RNA, 19 nt, Homo sapiens
ccaccaaacccggccugau

SEQ ID NO: 42627 - RNA, 14 nt, Homo sapiens
ccaccacgcccagc

SEQ ID NO: 42628 - RNA, 20 nt, Homo sapiens
ccaccagucugacuguuucc

SEQ ID NO: 42629 - RNA, 15 nt, Homo sapiens
ccacccgcccaccgc

SEQ ID NO: 42630 - RNA, 14 nt, Homo sapiens
ccacccuugccaug

SEQ ID NO: 42631 - RNA, 23 nt, Homo sapiens
ccaccgcagggugaacugcagcg

SEQ ID NO: 42632 - RNA, 14 nt, Homo sapiens
ccacgcucuggguc

SEQ ID NO: 42633 - RNA, 17 nt, Homo sapiens
ccacgcucugggucgcc

SEQ ID NO: 42634 - RNA, 19 nt, Homo sapiens
ccacgcucugggucgccgg

SEQ ID NO: 42635 - RNA, 12 nt, Homo sapiens
ccacggcuggag

SEQ ID NO: 42636 - RNA, 12 nt, Homo sapiens
ccacuacugcua

SEQ ID NO: 42637 - RNA, 11 nt, Homo sapiens
ccacucauuca

SEQ ID NO: 42638 - RNA, 16 nt, Homo sapiens
ccacuuauaggaauug

SEQ ID NO: 42639 - RNA, 21 nt, Homo sapiens
ccacuuauaggaauugaccca

SEQ ID NO: 42640 - RNA, 21 nt, Homo sapiens
ccacuuccucccggccgcgcu

SEQ ID NO: 42641 - RNA, 22 nt, Homo sapiens
ccacuuccucccggccgcgcug

SEQ ID NO: 42642 - RNA, 16 nt, Homo sapiens
ccacuuggacaugggc

SEQ ID NO: 42643 - RNA, 22 nt, Homo sapiens
ccacuuuccaauaaagaguucc

SEQ ID NO: 42644 - RNA, 14 nt, Homo sapiens
ccagaaugaccugg

SEQ ID NO: 42645 - RNA, 11 nt, Homo sapiens
ccagagaccag

SEQ ID NO: 42646 - RNA, 13 nt, Homo sapiens
ccagagcuacagg

SEQ ID NO: 42647 - RNA, 14 nt, Homo sapiens
ccagagcuacaggc

SEQ ID NO: 42648 - RNA, 17 nt, Homo sapiens
ccagagcuacaggcccc

SEQ ID NO: 42649 - RNA, 16 nt, Homo sapiens
ccagaucaagccugcc

SEQ ID NO: 42650 - RNA, 19 nt, Homo sapiens
ccagcacggggcuaagcau

SEQ ID NO: 42651 - RNA, 23 nt, Homo sapiens
ccagcacuuugggaggcugaggc

SEQ ID NO: 42652 - RNA, 17 nt, Homo sapiens
ccagcccuacaccauuc

SEQ ID NO: 42653 - RNA, 19 nt, Homo sapiens
ccagccugagcgacaguga

SEQ ID NO: 42654 - RNA, 16 nt, Homo sapiens
ccagccuugcuccugg

SEQ ID NO: 42655 - RNA, 18 nt, Homo sapiens
ccagcuacuugggaggcu

SEQ ID NO: 42656 - RNA, 19 nt, Homo sapiens
ccagcuacuugggaggcug

SEQ ID NO: 42657 - RNA, 23 nt, Homo sapiens
ccagcuacuugggaggcugaggc

SEQ ID NO: 42658 - RNA, 15 nt, Homo sapiens
ccagcucuaucccaa

SEQ ID NO: 42659 - RNA, 17 nt, Homo sapiens
ccagcugccccggggag

SEQ ID NO: 42660 - RNA, 16 nt, Homo sapiens
ccaggaaaaucugcac

SEQ ID NO: 42661 - RNA, 16 nt, Homo sapiens
ccaggaguuuggccag

SEQ ID NO: 42662 - RNA, 18 nt, Homo sapiens
ccaggaguuuggccagaa

SEQ ID NO: 42663 - RNA, 19 nt, Homo sapiens
ccaggaguuuggccagaag

SEQ ID NO: 42664 - RNA, 18 nt, Homo sapiens
ccaggauuuaaguuucac

SEQ ID NO: 42665 - RNA, 17 nt, Homo sapiens
ccaggcacccccagaau

SEQ ID NO: 42666 - RNA, 20 nt, Homo sapiens
ccaggcacccccagaaugac

SEQ ID NO: 42667 - RNA, 11 nt, Homo sapiens
ccaggcggcug

SEQ ID NO: 42668 - RNA, 13 nt, Homo sapiens
ccaggcggguccg

SEQ ID NO: 42669 - RNA, 15 nt, Homo sapiens
ccaggcggguccggg

SEQ ID NO: 42670 - RNA, 19 nt, Homo sapiens
ccaggcggguccgggucgc

SEQ ID NO: 42671 - RNA, 22 nt, Homo sapiens
ccaggcggguccgggucgcagg

SEQ ID NO: 42672 - RNA, 12 nt, Homo sapiens
ccaggcuggucu

SEQ ID NO: 42673 - RNA, 20 nt, Homo sapiens
ccagggacugaggggagggg

SEQ ID NO: 42674 - RNA, 13 nt, Homo sapiens
ccagggcuacgcg

SEQ ID NO: 42675 - RNA, 14 nt, Homo sapiens
ccagggcuacgcgc

SEQ ID NO: 42676 - RNA, 15 nt, Homo sapiens
ccagggcuacgcgcg

SEQ ID NO: 42677 - RNA, 17 nt, Homo sapiens
ccagggcuacgcgcgcu

SEQ ID NO: 42678 - RNA, 18 nt, Homo sapiens
ccagggcuacgcgcgcuc

SEQ ID NO: 42679 - RNA, 19 nt, Homo sapiens
ccagggcuacgcgcgcucc

SEQ ID NO: 42680 - RNA, 20 nt, Homo sapiens
ccagggcuacgcgcgcuccg

SEQ ID NO: 42681 - RNA, 23 nt, Homo sapiens
ccagggcuacgcgcgcuccgcgc

SEQ ID NO: 42682 - RNA, 18 nt, Homo sapiens
ccagggcuugugugcaca

SEQ ID NO: 42683 - RNA, 20 nt, Homo sapiens
ccagggcuugugugcacaua

SEQ ID NO: 42684 - RNA, 20 nt, Homo sapiens
ccagguagagagaccacaag

SEQ ID NO: 42685 - RNA, 17 nt, Homo sapiens
ccagguagagggugugu

SEQ ID NO: 42686 - RNA, 20 nt, Homo sapiens
ccaguaaaugggggugcauu

SEQ ID NO: 42687 - RNA, 17 nt, Homo sapiens
ccagucauuauguuaau

SEQ ID NO: 42688 - RNA, 13 nt, Homo sapiens
ccagugagacagc

SEQ ID NO: 42689 - RNA, 18 nt, Homo sapiens
ccagugagaucaauguga

SEQ ID NO: 42690 - RNA, 22 nt, Homo sapiens
ccaucaaggguacacugccuuc

SEQ ID NO: 42691 - RNA, 12 nt, Homo sapiens
ccaucccggccg

SEQ ID NO: 42692 - RNA, 13 nt, Homo sapiens
ccaucccggccgg

SEQ ID NO: 42693 - RNA, 14 nt, Homo sapiens
ccaucccggccggc

SEQ ID NO: 42694 - RNA, 15 nt, Homo sapiens
ccaucccggccggcg

SEQ ID NO: 42695 - RNA, 21 nt, Homo sapiens
ccaucccggccggcgcgcuca

SEQ ID NO: 42696 - RNA, 22 nt, Homo sapiens
ccaucccggccggcgcgcucau

SEQ ID NO: 42697 - RNA, 22 nt, Homo sapiens
ccaucuuucaagggaccucucc

SEQ ID NO: 42698 - RNA, 15 nt, Homo sapiens
ccaugagaguucugu

SEQ ID NO: 42699 - RNA, 22 nt, Homo sapiens
ccaugaucccaccucccauuca

SEQ ID NO: 42700 - RNA, 20 nt, Homo sapiens
ccaugauguuuagaaacaca

SEQ ID NO: 42701 - RNA, 12 nt, Homo sapiens
ccaugcuggcca

SEQ ID NO: 42702 - RNA, 16 nt, Homo sapiens
ccaugcuggccaggcu

SEQ ID NO: 42703 - RNA, 15 nt, Homo sapiens
ccauggagguuaagc

SEQ ID NO: 42704 - RNA, 16 nt, Homo sapiens
ccaugggcacuguggg

SEQ ID NO: 42705 - RNA, 21 nt, Homo sapiens
ccauggggguaauaagagcag

SEQ ID NO: 42706 - RNA, 19 nt, Homo sapiens
ccauuauauuuauuguuua

SEQ ID NO: 42707 - RNA, 16 nt, Homo sapiens
ccauucaggaugccca

SEQ ID NO: 42708 - RNA, 17 nt, Homo sapiens
ccauucaggaugcccac

SEQ ID NO: 42709 - RNA, 21 nt, Homo sapiens
ccauucaggaugcccacggcu

SEQ ID NO: 42710 - RNA, 12 nt, Homo sapiens
ccauuccaagcc

SEQ ID NO: 42711 - RNA, 15 nt, Homo sapiens
ccauuccaagccuga

SEQ ID NO: 42712 - RNA, 18 nt, Homo sapiens
ccauuccaagccugacca

SEQ ID NO: 42713 - RNA, 16 nt, Homo sapiens
ccauugugggcucugg

SEQ ID NO: 42714 - RNA, 14 nt, Homo sapiens
ccauuguggucaca

SEQ ID NO: 42715 - RNA, 16 nt, Homo sapiens
ccauuuuugaaaccaa

SEQ ID NO: 42716 - RNA, 17 nt, Homo sapiens
ccauuuuugaaaccaaa

SEQ ID NO: 42717 - RNA, 22 nt, Homo sapiens
cccaaaacugauacccuuugaa

SEQ ID NO: 42718 - RNA, 22 nt, Homo sapiens
cccaacuauaaaacuaggugcu

SEQ ID NO: 42719 - RNA, 14 nt, Homo sapiens
cccaagaaugagaa

SEQ ID NO: 42720 - RNA, 16 nt, Homo sapiens
cccacaagaaaugaaa

SEQ ID NO: 42721 - RNA, 20 nt, Homo sapiens
cccacaccagggccuggcug

SEQ ID NO: 42722 - RNA, 24 nt, Homo sapiens
cccacaccagggccuggcugggag

SEQ ID NO: 42723 - RNA, 14 nt, Homo sapiens
cccacccgcccacc

SEQ ID NO: 42724 - RNA, 13 nt, Homo sapiens
cccacggcuggag

SEQ ID NO: 42725 - RNA, 14 nt, Homo sapiens
cccacggcuggagc

SEQ ID NO: 42726 - RNA, 16 nt, Homo sapiens
cccacuuccucccggc

SEQ ID NO: 42727 - RNA, 17 nt, Homo sapiens
cccacuuccucccggcc

SEQ ID NO: 42728 - RNA, 18 nt, Homo sapiens
cccacuuccucccggccg

SEQ ID NO: 42729 - RNA, 19 nt, Homo sapiens
cccacuuccucccggccgc

SEQ ID NO: 42730 - RNA, 21 nt, Homo sapiens
cccacuuccucccggccgcgc

SEQ ID NO: 42731 - RNA, 11 nt, Homo sapiens
cccagauacca

SEQ ID NO: 42732 - RNA, 12 nt, Homo sapiens
cccagauaccau

SEQ ID NO: 42733 - RNA, 13 nt, Homo sapiens
cccagauaccaug

SEQ ID NO: 42734 - RNA, 22 nt, Homo sapiens
cccagcacuuugggaggcugag

SEQ ID NO: 42735 - RNA, 15 nt, Homo sapiens
cccagccccuugaga

SEQ ID NO: 42736 - RNA, 20 nt, Homo sapiens
cccagccccuugagaaaccu

SEQ ID NO: 42737 - RNA, 23 nt, Homo sapiens
cccagcgagggacaccgaguggc

SEQ ID NO: 42738 - RNA, 15 nt, Homo sapiens
cccagcuacuuggga

SEQ ID NO: 42739 - RNA, 22 nt, Homo sapiens
cccagcuacuugggaggcugag

SEQ ID NO: 42740 - RNA, 21 nt, Homo sapiens
cccagcuagaauucacuccac

SEQ ID NO: 42741 - RNA, 14 nt, Homo sapiens
cccaggaguuuggc

SEQ ID NO: 42742 - RNA, 16 nt, Homo sapiens
cccaggaguuuggcca

SEQ ID NO: 42743 - RNA, 13 nt, Homo sapiens
cccaggcgggucc

SEQ ID NO: 42744 - RNA, 19 nt, Homo sapiens
cccaggcggguccgggucg

SEQ ID NO: 42745 - RNA, 20 nt, Homo sapiens
cccaggcggguccgggucgc

SEQ ID NO: 42746 - RNA, 22 nt, Homo sapiens
cccauccugccccugagcccau

SEQ ID NO: 42747 - RNA, 18 nt, Homo sapiens
ccccagagcuacaggccc

SEQ ID NO: 42748 - RNA, 19 nt, Homo sapiens
ccccagagcuacaggcccc

SEQ ID NO: 42749 - RNA, 20 nt, Homo sapiens
ccccagagcuacaggcccca

SEQ ID NO: 42750 - RNA, 20 nt, Homo sapiens
ccccagauaccaugaugcug

SEQ ID NO: 42751 - RNA, 23 nt, Homo sapiens
ccccaggcggguccgggucgcag

SEQ ID NO: 42752 - RNA, 14 nt, Homo sapiens
ccccaucugguccu

SEQ ID NO: 42753 - RNA, 13 nt, Homo sapiens
cccccgggccgac

SEQ ID NO: 42754 - RNA, 21 nt, Homo sapiens
cccccgggccgacggagccgg

SEQ ID NO: 42755 - RNA, 14 nt, Homo sapiens
ccccgggaguggcg

SEQ ID NO: 42756 - RNA, 16 nt, Homo sapiens
ccccgggaguggcgcg

SEQ ID NO: 42757 - RNA, 20 nt, Homo sapiens
ccccgggaguggcgcgcgcc

SEQ ID NO: 42758 - RNA, 14 nt, Homo sapiens
ccccgggccgacgg

SEQ ID NO: 42759 - RNA, 17 nt, Homo sapiens
ccccgggccgacggagc

SEQ ID NO: 42760 - RNA, 18 nt, Homo sapiens
ccccgggccgacggagcc

SEQ ID NO: 42761 - RNA, 18 nt, Homo sapiens
ccccggggaggggcgcuc

SEQ ID NO: 42762 - RNA, 19 nt, Homo sapiens
ccccugcacuccagccuga

SEQ ID NO: 42763 - RNA, 20 nt, Homo sapiens
ccccugcacuccagccugag

SEQ ID NO: 42764 - RNA, 17 nt, Homo sapiens
cccgaaacuaccagccc

SEQ ID NO: 42765 - RNA, 13 nt, Homo sapiens
cccgcccaccgca

SEQ ID NO: 42766 - RNA, 18 nt, Homo sapiens
cccgcuguuccucgccac

SEQ ID NO: 42767 - RNA, 20 nt, Homo sapiens
cccgcuguuccucgccacgc

SEQ ID NO: 42768 - RNA, 11 nt, Homo sapiens
cccggccgcgc

SEQ ID NO: 42769 - RNA, 12 nt, Homo sapiens
cccggccgcgcu

SEQ ID NO: 42770 - RNA, 16 nt, Homo sapiens
cccggccgcgcugcgc

SEQ ID NO: 42771 - RNA, 17 nt, Homo sapiens
cccggccgcgcugcgcg

SEQ ID NO: 42772 - RNA, 18 nt, Homo sapiens
cccggccgcgcugcgcgc

SEQ ID NO: 42773 - RNA, 20 nt, Homo sapiens
cccggccgcgcugcgcgccg

SEQ ID NO: 42774 - RNA, 22 nt, Homo sapiens
cccggccgcgcugcgcgccgcg

SEQ ID NO: 42775 - RNA, 24 nt, Homo sapiens
cccggccgcgcugcgcgccgcgcu

SEQ ID NO: 42776 - RNA, 11 nt, Homo sapiens
cccggccggcg

SEQ ID NO: 42777 - RNA, 12 nt, Homo sapiens
cccggccggcgc

SEQ ID NO: 42778 - RNA, 13 nt, Homo sapiens
cccggccggcgcg

SEQ ID NO: 42779 - RNA, 15 nt, Homo sapiens
cccggccggcgcgcu

SEQ ID NO: 42780 - RNA, 14 nt, Homo sapiens
cccgggaguggcgc

SEQ ID NO: 42781 - RNA, 15 nt, Homo sapiens
cccgggaguggcgcg

SEQ ID NO: 42782 - RNA, 22 nt, Homo sapiens
cccgggaguggcgcgcgccacc

SEQ ID NO: 42783 - RNA, 12 nt, Homo sapiens
cccgggccgacg

SEQ ID NO: 42784 - RNA, 18 nt, Homo sapiens
cccgggccgacggagccg

SEQ ID NO: 42785 - RNA, 19 nt, Homo sapiens
cccgggccgacggagccgg

SEQ ID NO: 42786 - RNA, 20 nt, Homo sapiens
cccgggccgacggagccggg

SEQ ID NO: 42787 - RNA, 13 nt, Homo sapiens
cccggggaggggc

SEQ ID NO: 42788 - RNA, 14 nt, Homo sapiens
cccggggaggggcg

SEQ ID NO: 42789 - RNA, 15 nt, Homo sapiens
cccggggaggggcgc

SEQ ID NO: 42790 - RNA, 17 nt, Homo sapiens
cccggggaggggcgcuc

SEQ ID NO: 42791 - RNA, 18 nt, Homo sapiens
cccggggaggggcgcucg

SEQ ID NO: 42792 - RNA, 13 nt, Homo sapiens
cccgugugccuga

SEQ ID NO: 42793 - RNA, 15 nt, Homo sapiens
cccgugugccugagc

SEQ ID NO: 42794 - RNA, 11 nt, Homo sapiens
cccuacaccau

SEQ ID NO: 42795 - RNA, 12 nt, Homo sapiens
cccuacaccauu

SEQ ID NO: 42796 - RNA, 16 nt, Homo sapiens
cccuagcccuuacguc

SEQ ID NO: 42797 - RNA, 12 nt, Homo sapiens
cccucaugcugc

SEQ ID NO: 42798 - RNA, 13 nt, Homo sapiens
cccucaugcugcc

SEQ ID NO: 42799 - RNA, 15 nt, Homo sapiens
cccucaugcugccaa

SEQ ID NO: 42800 - RNA, 16 nt, Homo sapiens
cccucaugcugccaau

SEQ ID NO: 42801 - RNA, 13 nt, Homo sapiens
cccucuggcugcu

SEQ ID NO: 42802 - RNA, 11 nt, Homo sapiens
cccucuggguc

SEQ ID NO: 42803 - RNA, 12 nt, Homo sapiens
cccucugggucu

SEQ ID NO: 42804 - RNA, 20 nt, Homo sapiens
cccucugggucucagugucc

SEQ ID NO: 42805 - RNA, 18 nt, Homo sapiens
cccucuguugccaaggcu

SEQ ID NO: 42806 - RNA, 20 nt, Homo sapiens
cccucuguugccaaggcugg

SEQ ID NO: 42807 - RNA, 24 nt, Homo sapiens
cccucuguugccaaggcuggagug

SEQ ID NO: 42808 - RNA, 18 nt, Homo sapiens
cccugaaagucccagauc

SEQ ID NO: 42809 - RNA, 15 nt, Homo sapiens
cccugcacuccagcc

SEQ ID NO: 42810 - RNA, 12 nt, Homo sapiens
cccugccaccuc

SEQ ID NO: 42811 - RNA, 21 nt, Homo sapiens
cccugccaugcucuccaaacc

SEQ ID NO: 42812 - RNA, 15 nt, Homo sapiens
cccugugcggccugg

SEQ ID NO: 42813 - RNA, 17 nt, Homo sapiens
cccuuacaggaacagaa

SEQ ID NO: 42814 - RNA, 23 nt, Homo sapiens
cccuuacaggaacagaagaggaa

SEQ ID NO: 42815 - RNA, 18 nt, Homo sapiens
cccuucccacacugucca

SEQ ID NO: 42816 - RNA, 19 nt, Homo sapiens
cccuucuuacaaugcauuc

SEQ ID NO: 42817 - RNA, 18 nt, Homo sapiens
cccuuuuacauacugcug

SEQ ID NO: 42818 - RNA, 14 nt, Homo sapiens
ccgaagucuuccau

SEQ ID NO: 42819 - RNA, 12 nt, Homo sapiens
ccgacggagccg

SEQ ID NO: 42820 - RNA, 15 nt, Homo sapiens
ccgacggagccggga

SEQ ID NO: 42821 - RNA, 17 nt, Homo sapiens
ccgacggagccgggaaa

SEQ ID NO: 42822 - RNA, 19 nt, Homo sapiens
ccgacggagccgggaaaga

SEQ ID NO: 42823 - RNA, 22 nt, Homo sapiens
ccgcaaugugacuuaaugccac

SEQ ID NO: 42824 - RNA, 19 nt, Homo sapiens
ccgcagggugaacugcagc

SEQ ID NO: 42825 - RNA, 16 nt, Homo sapiens
ccgcauccuagucucu

SEQ ID NO: 42826 - RNA, 20 nt, Homo sapiens
ccgcauccuagucucuauca

SEQ ID NO: 42827 - RNA, 11 nt, Homo sapiens
ccgcccaccgc

SEQ ID NO: 42828 - RNA, 15 nt, Homo sapiens
ccgcccaccgcaggg

SEQ ID NO: 42829 - RNA, 18 nt, Homo sapiens
ccgcccaccgcaggguga

SEQ ID NO: 42830 - RNA, 16 nt, Homo sapiens
ccgcccaucuccgucu

SEQ ID NO: 42831 - RNA, 15 nt, Homo sapiens
ccgcgcagcucaggc

SEQ ID NO: 42832 - RNA, 17 nt, Homo sapiens
ccgcgcagcucaggcug

SEQ ID NO: 42833 - RNA, 19 nt, Homo sapiens
ccgcgcagcucaggcuggc

SEQ ID NO: 42834 - RNA, 20 nt, Homo sapiens
ccgcgcagcucaggcuggca

SEQ ID NO: 42835 - RNA, 21 nt, Homo sapiens
ccgcgcagcucaggcuggcac

SEQ ID NO: 42836 - RNA, 22 nt, Homo sapiens
ccgcgcagcucaggcuggcacc

SEQ ID NO: 42837 - RNA, 11 nt, Homo sapiens
ccgcgcugcgc

SEQ ID NO: 42838 - RNA, 12 nt, Homo sapiens
ccgcgcugcgcg

SEQ ID NO: 42839 - RNA, 13 nt, Homo sapiens
ccgcgcugcgcgc

SEQ ID NO: 42840 - RNA, 17 nt, Homo sapiens
ccgcgcugcgcgccgcg

SEQ ID NO: 42841 - RNA, 18 nt, Homo sapiens
ccgcgcugcgcgccgcgc

SEQ ID NO: 42842 - RNA, 19 nt, Homo sapiens
ccgcgcugcgcgccgcgcu

SEQ ID NO: 42843 - RNA, 20 nt, Homo sapiens
ccgcgcugcgcgccgcgcuc

SEQ ID NO: 42844 - RNA, 22 nt, Homo sapiens
ccgcgcugcgcgccgcgcuccu

SEQ ID NO: 42845 - RNA, 14 nt, Homo sapiens
ccgcuacuuccagg

SEQ ID NO: 42846 - RNA, 15 nt, Homo sapiens
ccgcuguacgcgagc

SEQ ID NO: 42847 - RNA, 16 nt, Homo sapiens
ccgcuguacgcgagcg

SEQ ID NO: 42848 - RNA, 17 nt, Homo sapiens
ccgcuguacgcgagcgc

SEQ ID NO: 42849 - RNA, 18 nt, Homo sapiens
ccgcuguacgcgagcgcg

SEQ ID NO: 42850 - RNA, 19 nt, Homo sapiens
ccgcuguacgcgagcgcgc

SEQ ID NO: 42851 - RNA, 21 nt, Homo sapiens
ccgcuguacgcgagcgcgcgc

SEQ ID NO: 42852 - RNA, 22 nt, Homo sapiens
ccgcuguacgcgagcgcgcgcg

SEQ ID NO: 42853 - RNA, 23 nt, Homo sapiens
ccgcuguacgcgagcgcgcgcgc

SEQ ID NO: 42854 - RNA, 24 nt, Homo sapiens
ccgcuguacgcgagcgcgcgcgcc

SEQ ID NO: 42855 - RNA, 15 nt, Homo sapiens
ccgcuguuccucgcc

SEQ ID NO: 42856 - RNA, 18 nt, Homo sapiens
ccgcuguuccucgccacg

SEQ ID NO: 42857 - RNA, 21 nt, Homo sapiens
ccgcuguuccucgccacgcuc

SEQ ID NO: 42858 - RNA, 23 nt, Homo sapiens
ccgcuguuccucgccacgcucug

SEQ ID NO: 42859 - RNA, 22 nt, Homo sapiens
ccggacgcugcugccgugggcc

SEQ ID NO: 42860 - RNA, 22 nt, Homo sapiens
ccggagccccuugggcagguca

SEQ ID NO: 42861 - RNA, 14 nt, Homo sapiens
ccggagccuccagc

SEQ ID NO: 42862 - RNA, 17 nt, Homo sapiens
ccggagccuccagcugc

SEQ ID NO: 42863 - RNA, 18 nt, Homo sapiens
ccggagccuccagcugcc

SEQ ID NO: 42864 - RNA, 21 nt, Homo sapiens
ccggagccuccagcugccccg

SEQ ID NO: 42865 - RNA, 11 nt, Homo sapiens
ccggccgcgcu

SEQ ID NO: 42866 - RNA, 12 nt, Homo sapiens
ccggccgcgcug

SEQ ID NO: 42867 - RNA, 13 nt, Homo sapiens
ccggccgcgcugc

SEQ ID NO: 42868 - RNA, 15 nt, Homo sapiens
ccggccgcgcugcgc

SEQ ID NO: 42869 - RNA, 19 nt, Homo sapiens
ccggccgcgcugcgcgccg

SEQ ID NO: 42870 - RNA, 20 nt, Homo sapiens
ccggccgcgcugcgcgccgc

SEQ ID NO: 42871 - RNA, 21 nt, Homo sapiens
ccggccgcgcugcgcgccgcg

SEQ ID NO: 42872 - RNA, 22 nt, Homo sapiens
ccggccgcgcugcgcgccgcgc

SEQ ID NO: 42873 - RNA, 23 nt, Homo sapiens
ccggccgcgcugcgcgccgcgcu

SEQ ID NO: 42874 - RNA, 16 nt, Homo sapiens
ccggccggcgcgcuca

SEQ ID NO: 42875 - RNA, 12 nt, Homo sapiens
ccggcgcgcuca

SEQ ID NO: 42876 - RNA, 17 nt, Homo sapiens
ccggcgcgcucauccca

SEQ ID NO: 42877 - RNA, 18 nt, Homo sapiens
ccggcgcgcucaucccac

SEQ ID NO: 42878 - RNA, 19 nt, Homo sapiens
ccggcgcgcucaucccacc

SEQ ID NO: 42879 - RNA, 22 nt, Homo sapiens
ccggcgcgcucaucccacccgc

SEQ ID NO: 42880 - RNA, 17 nt, Homo sapiens
ccgggaaagaagagccg

SEQ ID NO: 42881 - RNA, 18 nt, Homo sapiens
ccgggaaagaagagccgg

SEQ ID NO: 42882 - RNA, 19 nt, Homo sapiens
ccgggaaagaagagccgga

SEQ ID NO: 42883 - RNA, 20 nt, Homo sapiens
ccgggaaagaagagccggag

SEQ ID NO: 42884 - RNA, 21 nt, Homo sapiens
ccgggaaagaagagccggagc

SEQ ID NO: 42885 - RNA, 23 nt, Homo sapiens
ccgggaaagaagagccggagccu

SEQ ID NO: 42886 - RNA, 14 nt, Homo sapiens
ccgggaguggcgcg

SEQ ID NO: 42887 - RNA, 18 nt, Homo sapiens
ccgggaguggcgcgcgcc

SEQ ID NO: 42888 - RNA, 19 nt, Homo sapiens
ccgggcaugguggcgcgca

SEQ ID NO: 42889 - RNA, 11 nt, Homo sapiens
ccgggccgacg

SEQ ID NO: 42890 - RNA, 12 nt, Homo sapiens
ccgggccgacgg

SEQ ID NO: 42891 - RNA, 13 nt, Homo sapiens
ccgggccgacgga

SEQ ID NO: 42892 - RNA, 16 nt, Homo sapiens
ccgggccgacggagcc

SEQ ID NO: 42893 - RNA, 19 nt, Homo sapiens
ccgggccgacggagccggg

SEQ ID NO: 42894 - RNA, 20 nt, Homo sapiens
ccgggccgacggagccggga

SEQ ID NO: 42895 - RNA, 21 nt, Homo sapiens
ccgggccgacggagccgggaa

SEQ ID NO: 42896 - RNA, 11 nt, Homo sapiens
ccgggcgcggu

SEQ ID NO: 42897 - RNA, 18 nt, Homo sapiens
ccgggcgcgguggcucac

SEQ ID NO: 42898 - RNA, 16 nt, Homo sapiens
ccgggcguggugguga

SEQ ID NO: 42899 - RNA, 12 nt, Homo sapiens
ccggggaggggc

SEQ ID NO: 42900 - RNA, 14 nt, Homo sapiens
ccggggaggggcgc

SEQ ID NO: 42901 - RNA, 17 nt, Homo sapiens
ccggggaggggcgcucg

SEQ ID NO: 42902 - RNA, 18 nt, Homo sapiens
ccggggaggggcgcucgc

SEQ ID NO: 42903 - RNA, 23 nt, Homo sapiens
ccggggaggggcgcucgcuuccg

SEQ ID NO: 42904 - RNA, 14 nt, Homo sapiens
ccgggucgcaggac

SEQ ID NO: 42905 - RNA, 15 nt, Homo sapiens
ccgggucgcaggacc

SEQ ID NO: 42906 - RNA, 22 nt, Homo sapiens
ccgggucgcaggaccaucccgg

SEQ ID NO: 42907 - RNA, 15 nt, Homo sapiens
ccgguccuugcugca

SEQ ID NO: 42908 - RNA, 23 nt, Homo sapiens
ccgguccuugcugcaccugugcc

SEQ ID NO: 42909 - RNA, 19 nt, Homo sapiens
ccgucucccaaagugcugg

SEQ ID NO: 42910 - RNA, 12 nt, Homo sapiens
ccgugggccuga

SEQ ID NO: 42911 - RNA, 13 nt, Homo sapiens
ccgugggccugag

SEQ ID NO: 42912 - RNA, 13 nt, Homo sapiens
ccgugugccugag

SEQ ID NO: 42913 - RNA, 22 nt, Homo sapiens
ccguuuugugaagaaacauuua

SEQ ID NO: 42914 - RNA, 14 nt, Homo sapiens
ccuaaccagccugg

SEQ ID NO: 42915 - RNA, 14 nt, Homo sapiens
ccuaagucccugcu

SEQ ID NO: 42916 - RNA, 15 nt, Homo sapiens
ccuaagucccugcug

SEQ ID NO: 42917 - RNA, 18 nt, Homo sapiens
ccuaagucccugcugccc

SEQ ID NO: 42918 - RNA, 19 nt, Homo sapiens
ccuaagucccugcugcccu

SEQ ID NO: 42919 - RNA, 14 nt, Homo sapiens
ccuaagugcagccc

SEQ ID NO: 42920 - RNA, 16 nt, Homo sapiens
ccuaaguuucaguuga

SEQ ID NO: 42921 - RNA, 17 nt, Homo sapiens
ccuaauaaaaaggugac

SEQ ID NO: 42922 - RNA, 18 nt, Homo sapiens
ccuaauaaaaaggugacc

SEQ ID NO: 42923 - RNA, 19 nt, Homo sapiens
ccuaauaaaaaggugacca

SEQ ID NO: 42924 - RNA, 20 nt, Homo sapiens
ccuaauaaaaaggugaccau

SEQ ID NO: 42925 - RNA, 21 nt, Homo sapiens
ccuacauguauuuguuugcau

SEQ ID NO: 42926 - RNA, 14 nt, Homo sapiens
ccuacugugucuca

SEQ ID NO: 42927 - RNA, 17 nt, Homo sapiens
ccuagcacacacuuuug

SEQ ID NO: 42928 - RNA, 13 nt, Homo sapiens
ccuagcgcagcca

SEQ ID NO: 42929 - RNA, 11 nt, Homo sapiens
ccuagggugau

SEQ ID NO: 42930 - RNA, 11 nt, Homo sapiens
ccuauaauuuu

SEQ ID NO: 42931 - RNA, 15 nt, Homo sapiens
ccuauauccugugac

SEQ ID NO: 42932 - RNA, 11 nt, Homo sapiens
ccucaagccag

SEQ ID NO: 42933 - RNA, 14 nt, Homo sapiens
ccucaagccagccu

SEQ ID NO: 42934 - RNA, 15 nt, Homo sapiens
ccucaagccagccuu

SEQ ID NO: 42935 - RNA, 14 nt, Homo sapiens
ccucaccccuugcc

SEQ ID NO: 42936 - RNA, 12 nt, Homo sapiens
ccucaccucuca

SEQ ID NO: 42937 - RNA, 16 nt, Homo sapiens
ccucaccucucaccuc

SEQ ID NO: 42938 - RNA, 22 nt, Homo sapiens
ccucagaaaacaaggaugaauu

SEQ ID NO: 42939 - RNA, 19 nt, Homo sapiens
ccucagggugcacacagga

SEQ ID NO: 42940 - RNA, 20 nt, Homo sapiens
ccucaucuguaaaauggaga

SEQ ID NO: 42941 - RNA, 22 nt, Homo sapiens
ccucaucuguaaaauggagaca

SEQ ID NO: 42942 - RNA, 15 nt, Homo sapiens
ccucaugcugccaau

SEQ ID NO: 42943 - RNA, 19 nt, Homo sapiens
ccucauggaauuggagcuc

SEQ ID NO: 42944 - RNA, 20 nt, Homo sapiens
ccucauggaauuggagcucg

SEQ ID NO: 42945 - RNA, 22 nt, Homo sapiens
ccucauggaauuggagcucgug

SEQ ID NO: 42946 - RNA, 20 nt, Homo sapiens
ccucauuccccaaccacuuc

SEQ ID NO: 42947 - RNA, 20 nt, Homo sapiens
ccuccaccuucuggguucaa

SEQ ID NO: 42948 - RNA, 12 nt, Homo sapiens
ccuccagcugcc

SEQ ID NO: 42949 - RNA, 16 nt, Homo sapiens
ccuccagcugccccgg

SEQ ID NO: 42950 - RNA, 19 nt, Homo sapiens
ccucccauucaggaugccc

SEQ ID NO: 42951 - RNA, 22 nt, Homo sapiens
ccucccauucaggaugcccacg

SEQ ID NO: 42952 - RNA, 11 nt, Homo sapiens
ccucccggccg

SEQ ID NO: 42953 - RNA, 12 nt, Homo sapiens
ccucccggccgc

SEQ ID NO: 42954 - RNA, 14 nt, Homo sapiens
ccucccggccgcgc

SEQ ID NO: 42955 - RNA, 22 nt, Homo sapiens
ccucccggccgcgcugcgcgcc

SEQ ID NO: 42956 - RNA, 23 nt, Homo sapiens
ccucccggccgcgcugcgcgccg

SEQ ID NO: 42957 - RNA, 15 nt, Homo sapiens
ccuccgcuacuucca

SEQ ID NO: 42958 - RNA, 22 nt, Homo sapiens
ccuccuccuucauggcaggcau

SEQ ID NO: 42959 - RNA, 21 nt, Homo sapiens
ccuccugccuaagugcagccc

SEQ ID NO: 42960 - RNA, 14 nt, Homo sapiens
ccuccugcuuccuc

SEQ ID NO: 42961 - RNA, 15 nt, Homo sapiens
ccucgccacgcucug

SEQ ID NO: 42962 - RNA, 23 nt, Homo sapiens
ccucgccacgcucugggucgccg

SEQ ID NO: 42963 - RNA, 15 nt, Homo sapiens
ccucggacggcuccg

SEQ ID NO: 42964 - RNA, 17 nt, Homo sapiens
ccucggacggcuccgga

SEQ ID NO: 42965 - RNA, 19 nt, Homo sapiens
ccucggacggcuccggacg

SEQ ID NO: 42966 - RNA, 17 nt, Homo sapiens
ccucuaaauucuuucau

SEQ ID NO: 42967 - RNA, 14 nt, Homo sapiens
ccucucaaccaccu

SEQ ID NO: 42968 - RNA, 14 nt, Homo sapiens
ccucucucauccac

SEQ ID NO: 42969 - RNA, 16 nt, Homo sapiens
ccucucuuauagaaua

SEQ ID NO: 42970 - RNA, 13 nt, Homo sapiens
ccucuggcugcug

SEQ ID NO: 42971 - RNA, 14 nt, Homo sapiens
ccucuggcugcugg

SEQ ID NO: 42972 - RNA, 17 nt, Homo sapiens
ccucuggcugcuggugg

SEQ ID NO: 42973 - RNA, 13 nt, Homo sapiens
ccucuguugccaa

SEQ ID NO: 42974 - RNA, 17 nt, Homo sapiens
ccucuguugccaaggcu

SEQ ID NO: 42975 - RNA, 18 nt, Homo sapiens
ccucuguugccaaggcug

SEQ ID NO: 42976 - RNA, 12 nt, Homo sapiens
ccucuuucaaag

SEQ ID NO: 42977 - RNA, 13 nt, Homo sapiens
ccucuuucaaagg

SEQ ID NO: 42978 - RNA, 23 nt, Homo sapiens
ccugaaagucccagaucaagccu

SEQ ID NO: 42979 - RNA, 21 nt, Homo sapiens
ccugacagcccaagggugggu

SEQ ID NO: 42980 - RNA, 15 nt, Homo sapiens
ccugagacacauggg

SEQ ID NO: 42981 - RNA, 20 nt, Homo sapiens
ccugagacacaugggugcua

SEQ ID NO: 42982 - RNA, 23 nt, Homo sapiens
ccugagaccaaggcccccgggcc

SEQ ID NO: 42983 - RNA, 12 nt, Homo sapiens
ccugagaccagc

SEQ ID NO: 42984 - RNA, 17 nt, Homo sapiens
ccugagaccagccaacc

SEQ ID NO: 42985 - RNA, 8 nt, Homo sapiens
ccugagcc

SEQ ID NO: 42986 - RNA, 9 nt, Homo sapiens
ccugagccc

SEQ ID NO: 42987 - RNA, 10 nt, Homo sapiens
ccugagcccc

SEQ ID NO: 42988 - RNA, 19 nt, Homo sapiens
ccugagcggaccuucccag

SEQ ID NO: 42989 - RNA, 20 nt, Homo sapiens
ccugagcggaccuucccagc

SEQ ID NO: 42990 - RNA, 21 nt, Homo sapiens
ccugagcggaccuucccagcu

SEQ ID NO: 42991 - RNA, 18 nt, Homo sapiens
ccugaugaaaacauagca

SEQ ID NO: 42992 - RNA, 13 nt, Homo sapiens
ccugcaauuccac

SEQ ID NO: 42993 - RNA, 14 nt, Homo sapiens
ccugcacuccagcc

SEQ ID NO: 42994 - RNA, 21 nt, Homo sapiens
ccugcacuccagccugagcga

SEQ ID NO: 42995 - RNA, 12 nt, Homo sapiens
ccugcaggcgug

SEQ ID NO: 42996 - RNA, 14 nt, Homo sapiens
ccugcaggcgugac

SEQ ID NO: 42997 - RNA, 15 nt, Homo sapiens
ccugcaggcgugacc

SEQ ID NO: 42998 - RNA, 19 nt, Homo sapiens
ccugcaggcgugaccugac

SEQ ID NO: 42999 - RNA, 14 nt, Homo sapiens
ccugccccugagcc

SEQ ID NO: 43000 - RNA, 15 nt, Homo sapiens
ccugccccugagccc

SEQ ID NO: 43001 - RNA, 16 nt, Homo sapiens
ccugccccugagccca

SEQ ID NO: 43002 - RNA, 20 nt, Homo sapiens
ccugcccuuacaggaacaga

SEQ ID NO: 43003 - RNA, 11 nt, Homo sapiens
ccugccuggau

SEQ ID NO: 43004 - RNA, 23 nt, Homo sapiens
ccugcuggauguggagggggcgc

SEQ ID NO: 43005 - RNA, 21 nt, Homo sapiens
ccugcuguuuccuagcgcagc

SEQ ID NO: 43006 - RNA, 22 nt, Homo sapiens
ccugcuguuuccuagcgcagcc

SEQ ID NO: 43007 - RNA, 13 nt, Homo sapiens
ccugcuuccuccg

SEQ ID NO: 43008 - RNA, 20 nt, Homo sapiens
ccuggaaaucaggguuagua

SEQ ID NO: 43009 - RNA, 17 nt, Homo sapiens
ccuggacaguuuucugc

SEQ ID NO: 43010 - RNA, 13 nt, Homo sapiens
ccuggauggcugc

SEQ ID NO: 43011 - RNA, 17 nt, Homo sapiens
ccuggauggcugccuca

SEQ ID NO: 43012 - RNA, 18 nt, Homo sapiens
ccuggauuccucacuuug

SEQ ID NO: 43013 - RNA, 21 nt, Homo sapiens
ccuggcaaagaugaucaguau

SEQ ID NO: 43014 - RNA, 17 nt, Homo sapiens
ccuggcugggaguggca

SEQ ID NO: 43015 - RNA, 16 nt, Homo sapiens
ccuggucaacauggug

SEQ ID NO: 43016 - RNA, 17 nt, Homo sapiens
ccuggucaacaugguga

SEQ ID NO: 43017 - RNA, 22 nt, Homo sapiens
ccuggucuaccuguucgcgcgc

SEQ ID NO: 43018 - RNA, 23 nt, Homo sapiens
ccuggucuaccuguucgcgcgcc

SEQ ID NO: 43019 - RNA, 13 nt, Homo sapiens
ccuguaaucacag

SEQ ID NO: 43020 - RNA, 15 nt, Homo sapiens
ccuguacuccagccu

SEQ ID NO: 43021 - RNA, 16 nt, Homo sapiens
ccuguacuccagccug

SEQ ID NO: 43022 - RNA, 21 nt, Homo sapiens
ccugucccugcagacaugaga

SEQ ID NO: 43023 - RNA, 11 nt, Homo sapiens
ccugugacugu

SEQ ID NO: 43024 - RNA, 12 nt, Homo sapiens
ccugugacuguc

SEQ ID NO: 43025 - RNA, 14 nt, Homo sapiens
ccugugcggccugg

SEQ ID NO: 43026 - RNA, 16 nt, Homo sapiens
ccugugcggccugguc

SEQ ID NO: 43027 - RNA, 15 nt, Homo sapiens
ccuguguuacugauu

SEQ ID NO: 43028 - RNA, 21 nt, Homo sapiens
ccuguuaaaagaugaaaauau

SEQ ID NO: 43029 - RNA, 14 nt, Homo sapiens
ccuguucgcgcgcc

SEQ ID NO: 43030 - RNA, 16 nt, Homo sapiens
ccuguucgcgcgccuc

SEQ ID NO: 43031 - RNA, 17 nt, Homo sapiens
ccuguucgcgcgccucc

SEQ ID NO: 43032 - RNA, 18 nt, Homo sapiens
ccuguucgcgcgccuccg

SEQ ID NO: 43033 - RNA, 20 nt, Homo sapiens
ccuguucgcgcgccuccgcu

SEQ ID NO: 43034 - RNA, 13 nt, Homo sapiens
ccuuaaacucagg

SEQ ID NO: 43035 - RNA, 18 nt, Homo sapiens
ccuuauucagaauuucua

SEQ ID NO: 43036 - RNA, 21 nt, Homo sapiens
ccuuauuguaccucucuuaua

SEQ ID NO: 43037 - RNA, 20 nt, Homo sapiens
ccuucauggcaggcaucgcc

SEQ ID NO: 43038 - RNA, 11 nt, Homo sapiens
ccuucauuuuu

SEQ ID NO: 43039 - RNA, 16 nt, Homo sapiens
ccuuccccuucccaca

SEQ ID NO: 43040 - RNA, 11 nt, Homo sapiens
ccuucugcucc

SEQ ID NO: 43041 - RNA, 16 nt, Homo sapiens
ccuucuggguucaagc

SEQ ID NO: 43042 - RNA, 15 nt, Homo sapiens
ccuugcuccuggcug

SEQ ID NO: 43043 - RNA, 16 nt, Homo sapiens
ccuugcuccuggcugg

SEQ ID NO: 43044 - RNA, 12 nt, Homo sapiens
ccuugcugcacc

SEQ ID NO: 43045 - RNA, 21 nt, Homo sapiens
ccuugcugcaccugugccguc

SEQ ID NO: 43046 - RNA, 17 nt, Homo sapiens
ccuuggggcugaugcag

SEQ ID NO: 43047 - RNA, 15 nt, Homo sapiens
ccuuuacauccagau

SEQ ID NO: 43048 - RNA, 19 nt, Homo sapiens
ccuuuggaugcacuuuaua

SEQ ID NO: 43049 - RNA, 13 nt, Homo sapiens
ccuuugggaaagg

SEQ ID NO: 43050 - RNA, 17 nt, Homo sapiens
ccuuuuacauacugcug

SEQ ID NO: 43051 - RNA, 12 nt, Homo sapiens
ccuuuucccaac

SEQ ID NO: 43052 - RNA, 15 nt, Homo sapiens
ccuuuuuuauacaua

SEQ ID NO: 43053 - RNA, 13 nt, Homo sapiens
cgaacugauguaa

SEQ ID NO: 43054 - RNA, 12 nt, Homo sapiens
cgaacugcugga

SEQ ID NO: 43055 - RNA, 13 nt, Homo sapiens
cgaacugcuggau

SEQ ID NO: 43056 - RNA, 20 nt, Homo sapiens
cgaaguauccuucagccuga

SEQ ID NO: 43057 - RNA, 21 nt, Homo sapiens
cgaaguauccuucagccugaa

SEQ ID NO: 43058 - RNA, 13 nt, Homo sapiens
cgaagucuuccau

SEQ ID NO: 43059 - RNA, 11 nt, Homo sapiens
cgacaguuuuc

SEQ ID NO: 43060 - RNA, 23 nt, Homo sapiens
cgacaguuuuccuucucaucugu

SEQ ID NO: 43061 - RNA, 16 nt, Homo sapiens
cgacggagccgggaaa

SEQ ID NO: 43062 - RNA, 23 nt, Homo sapiens
cgacggagccgggaaagaagagc

SEQ ID NO: 43063 - RNA, 12 nt, Homo sapiens
cgagccccaggc

SEQ ID NO: 43064 - RNA, 17 nt, Homo sapiens
cgagccccaggcggguc

SEQ ID NO: 43065 - RNA, 18 nt, Homo sapiens
cgagccccaggcgggucc

SEQ ID NO: 43066 - RNA, 22 nt, Homo sapiens
cgagccccaggcggguccgggu

SEQ ID NO: 43067 - RNA, 11 nt, Homo sapiens
cgagcgcgcgc

SEQ ID NO: 43068 - RNA, 15 nt, Homo sapiens
cgagcgcgcgcgccc

SEQ ID NO: 43069 - RNA, 17 nt, Homo sapiens
cgagcgcgcgcgcccuc

SEQ ID NO: 43070 - RNA, 18 nt, Homo sapiens
cgagcgcgcgcgcccucu

SEQ ID NO: 43071 - RNA, 17 nt, Homo sapiens
cgagcguugcugggggg

SEQ ID NO: 43072 - RNA, 20 nt, Homo sapiens
cgaguggcccuucauguaca

SEQ ID NO: 43073 - RNA, 21 nt, Homo sapiens
cgauuauuauuuuagagcauc

SEQ ID NO: 43074 - RNA, 16 nt, Homo sapiens
cgcaaugugacuuaau

SEQ ID NO: 43075 - RNA, 17 nt, Homo sapiens
cgcaccuguaaucccag

SEQ ID NO: 43076 - RNA, 19 nt, Homo sapiens
cgcaccuguaaucccagcu

SEQ ID NO: 43077 - RNA, 20 nt, Homo sapiens
cgcaccuguaaucccagcua

SEQ ID NO: 43078 - RNA, 14 nt, Homo sapiens
cgcagccaugugau

SEQ ID NO: 43079 - RNA, 15 nt, Homo sapiens
cgcagccaugugauu

SEQ ID NO: 43080 - RNA, 15 nt, Homo sapiens
cgcagcucaggcugg

SEQ ID NO: 43081 - RNA, 16 nt, Homo sapiens
cgcagcucaggcuggc

SEQ ID NO: 43082 - RNA, 18 nt, Homo sapiens
cgcagcucaggcuggcac

SEQ ID NO: 43083 - RNA, 20 nt, Homo sapiens
cgcagcucaggcuggcaccg

SEQ ID NO: 43084 - RNA, 19 nt, Homo sapiens
cgcaggaccaucccggccg

SEQ ID NO: 43085 - RNA, 20 nt, Homo sapiens
cgcaggaccaucccggccgg

SEQ ID NO: 43086 - RNA, 22 nt, Homo sapiens
cgcaggaccaucccggccggcg

SEQ ID NO: 43087 - RNA, 20 nt, Homo sapiens
cgcaggcccccaggugccag

SEQ ID NO: 43088 - RNA, 15 nt, Homo sapiens
cgcauccuagucucu

SEQ ID NO: 43089 - RNA, 17 nt, Homo sapiens
cgcauccuagucucuau

SEQ ID NO: 43090 - RNA, 14 nt, Homo sapiens
cgccaccacgccca

SEQ ID NO: 43091 - RNA, 17 nt, Homo sapiens
cgccaccacgcccagcu

SEQ ID NO: 43092 - RNA, 13 nt, Homo sapiens
cgccacgcucugg

SEQ ID NO: 43093 - RNA, 14 nt, Homo sapiens
cgccacgcucuggg

SEQ ID NO: 43094 - RNA, 18 nt, Homo sapiens
cgccacgcucugggucgc

SEQ ID NO: 43095 - RNA, 21 nt, Homo sapiens
cgccacgcucugggucgccgg

SEQ ID NO: 43096 - RNA, 23 nt, Homo sapiens
cgccacgcucugggucgccggca

SEQ ID NO: 43097 - RNA, 15 nt, Homo sapiens
cgcccacuuccuccc

SEQ ID NO: 43098 - RNA, 17 nt, Homo sapiens
cgcccacuuccucccgg

SEQ ID NO: 43099 - RNA, 18 nt, Homo sapiens
cgcccacuuccucccggc

SEQ ID NO: 43100 - RNA, 21 nt, Homo sapiens
cgcccacuuccucccggccgc

SEQ ID NO: 43101 - RNA, 22 nt, Homo sapiens
cgcccacuuccucccggccgcg

SEQ ID NO: 43102 - RNA, 11 nt, Homo sapiens
cgcccucuggc

SEQ ID NO: 43103 - RNA, 18 nt, Homo sapiens
cgcccucuggcugcuggu

SEQ ID NO: 43104 - RNA, 15 nt, Homo sapiens
cgccgcgcuccucgg

SEQ ID NO: 43105 - RNA, 21 nt, Homo sapiens
cgccuccgcuacuuccagggc

SEQ ID NO: 43106 - RNA, 13 nt, Homo sapiens
cgccuguaauccc

SEQ ID NO: 43107 - RNA, 15 nt, Homo sapiens
cgccuguaaucccag

SEQ ID NO: 43108 - RNA, 16 nt, Homo sapiens
cgccuguaaucccagc

SEQ ID NO: 43109 - RNA, 16 nt, Homo sapiens
cgcgagcgcgcgcgcc

SEQ ID NO: 43110 - RNA, 17 nt, Homo sapiens
cgcgagcgcgcgcgccc

SEQ ID NO: 43111 - RNA, 18 nt, Homo sapiens
cgcgagcgcgcgcgcccu

SEQ ID NO: 43112 - RNA, 21 nt, Homo sapiens
cgcgagcgcgcgcgcccucug

SEQ ID NO: 43113 - RNA, 12 nt, Homo sapiens
cgcgcaccugua

SEQ ID NO: 43114 - RNA, 20 nt, Homo sapiens
cgcgcaccuguaaucccagc

SEQ ID NO: 43115 - RNA, 21 nt, Homo sapiens
cgcgcaccuguaaucccagcu

SEQ ID NO: 43116 - RNA, 13 nt, Homo sapiens
cgcgcagcucagg

SEQ ID NO: 43117 - RNA, 14 nt, Homo sapiens
cgcgcagcucaggc

SEQ ID NO: 43118 - RNA, 20 nt, Homo sapiens
cgcgcagcucaggcuggcac

SEQ ID NO: 43119 - RNA, 21 nt, Homo sapiens
cgcgcagcucaggcuggcacc

SEQ ID NO: 43120 - RNA, 19 nt, Homo sapiens
cgcgccaccacgcccagcu

SEQ ID NO: 43121 - RNA, 13 nt, Homo sapiens
cgcgcccucuggc

SEQ ID NO: 43122 - RNA, 15 nt, Homo sapiens
cgcgcccucuggcug

SEQ ID NO: 43123 - RNA, 16 nt, Homo sapiens
cgcgcccucuggcugc

SEQ ID NO: 43124 - RNA, 18 nt, Homo sapiens
cgcgcccucuggcugcug

SEQ ID NO: 43125 - RNA, 20 nt, Homo sapiens
cgcgcccucuggcugcuggu

SEQ ID NO: 43126 - RNA, 23 nt, Homo sapiens
cgcgcccucuggcugcugguggc

SEQ ID NO: 43127 - RNA, 15 nt, Homo sapiens
cgcgccgcgcuccuc

SEQ ID NO: 43128 - RNA, 18 nt, Homo sapiens
cgcgccgcgcuccucgga

SEQ ID NO: 43129 - RNA, 19 nt, Homo sapiens
cgcgccgcgcuccucggac

SEQ ID NO: 43130 - RNA, 22 nt, Homo sapiens
cgcgccgcgcuccucggacggc

SEQ ID NO: 43131 - RNA, 13 nt, Homo sapiens
cgcgccuccgcua

SEQ ID NO: 43132 - RNA, 13 nt, Homo sapiens
cgcgcgccaccac

SEQ ID NO: 43133 - RNA, 14 nt, Homo sapiens
cgcgcgccaccacg

SEQ ID NO: 43134 - RNA, 15 nt, Homo sapiens
cgcgcgccaccacgc

SEQ ID NO: 43135 - RNA, 17 nt, Homo sapiens
cgcgcgccaccacgccc

SEQ ID NO: 43136 - RNA, 18 nt, Homo sapiens
cgcgcgccaccacgccca

SEQ ID NO: 43137 - RNA, 13 nt, Homo sapiens
cgcgcgcccucug

SEQ ID NO: 43138 - RNA, 14 nt, Homo sapiens
cgcgcgcccucugg

SEQ ID NO: 43139 - RNA, 10 nt, Homo sapiens
cgcgcgccuc

SEQ ID NO: 43140 - RNA, 14 nt, Homo sapiens
cgcgcgccuccgcu

SEQ ID NO: 43141 - RNA, 17 nt, Homo sapiens
cgcgcgccuccgcuacu

SEQ ID NO: 43142 - RNA, 18 nt, Homo sapiens
cgcgcgccuccgcuacuu

SEQ ID NO: 43143 - RNA, 23 nt, Homo sapiens
cgcgcgccuccgcuacuuccagg

SEQ ID NO: 43144 - RNA, 12 nt, Homo sapiens
cgcgcgcgcccu

SEQ ID NO: 43145 - RNA, 13 nt, Homo sapiens
cgcgcgcgcccuc

SEQ ID NO: 43146 - RNA, 11 nt, Homo sapiens
cgcgcgcuccg

SEQ ID NO: 43147 - RNA, 12 nt, Homo sapiens
cgcgcgcuccgc

SEQ ID NO: 43148 - RNA, 15 nt, Homo sapiens
cgcgcgcuccgcgca

SEQ ID NO: 43149 - RNA, 18 nt, Homo sapiens
cgcgcgcuccgcgcagcu

SEQ ID NO: 43150 - RNA, 22 nt, Homo sapiens
cgcgcucaucccacccgcccac

SEQ ID NO: 43151 - RNA, 11 nt, Homo sapiens
cgcgcuccgcg

SEQ ID NO: 43152 - RNA, 15 nt, Homo sapiens
cgcgcuccgcgcagc

SEQ ID NO: 43153 - RNA, 16 nt, Homo sapiens
cgcgcuccgcgcagcu

SEQ ID NO: 43154 - RNA, 16 nt, Homo sapiens
cgcgcuccucggacgg

SEQ ID NO: 43155 - RNA, 17 nt, Homo sapiens
cgcgcuccucggacggc

SEQ ID NO: 43156 - RNA, 11 nt, Homo sapiens
cgcgcugcgcg

SEQ ID NO: 43157 - RNA, 13 nt, Homo sapiens
cgcgcugcgcgcc

SEQ ID NO: 43158 - RNA, 14 nt, Homo sapiens
cgcgcugcgcgccg

SEQ ID NO: 43159 - RNA, 17 nt, Homo sapiens
cgcgcugcgcgccgcgc

SEQ ID NO: 43160 - RNA, 19 nt, Homo sapiens
cgcgcugcgcgccgcgcuc

SEQ ID NO: 43161 - RNA, 20 nt, Homo sapiens
cgcgcugcgcgccgcgcucc

SEQ ID NO: 43162 - RNA, 19 nt, Homo sapiens
cgcggcgggagggcgcggg

SEQ ID NO: 43163 - RNA, 22 nt, Homo sapiens
cgcggcgggagggcgcggggcg

SEQ ID NO: 43164 - RNA, 16 nt, Homo sapiens
cgcggggcggggagcg

SEQ ID NO: 43165 - RNA, 23 nt, Homo sapiens
cgcggggcggggagcgagcccca

SEQ ID NO: 43166 - RNA, 16 nt, Homo sapiens
cgcgguggcucacgcc

SEQ ID NO: 43167 - RNA, 11 nt, Homo sapiens
cgcgugcaggc

SEQ ID NO: 43168 - RNA, 14 nt, Homo sapiens
cgcgugcaggcagc

SEQ ID NO: 43169 - RNA, 16 nt, Homo sapiens
cgcuaccucuccagcc

SEQ ID NO: 43170 - RNA, 16 nt, Homo sapiens
cgcuacuuccagggcu

SEQ ID NO: 43171 - RNA, 17 nt, Homo sapiens
cgcuacuuccagggcua

SEQ ID NO: 43172 - RNA, 22 nt, Homo sapiens
cgcuacuuccagggcuacgcgc

SEQ ID NO: 43173 - RNA, 12 nt, Homo sapiens
cgcucaucccac

SEQ ID NO: 43174 - RNA, 23 nt, Homo sapiens
cgcucaucccacccgcccaccgc

SEQ ID NO: 43175 - RNA, 14 nt, Homo sapiens
cgcuccgcgcagcu

SEQ ID NO: 43176 - RNA, 20 nt, Homo sapiens
cgcuccucggacggcuccgg

SEQ ID NO: 43177 - RNA, 13 nt, Homo sapiens
cgcucgcuuccgc

SEQ ID NO: 43178 - RNA, 15 nt, Homo sapiens
cgcucgcuuccgcau

SEQ ID NO: 43179 - RNA, 16 nt, Homo sapiens
cgcucgcuuccgcauc

SEQ ID NO: 43180 - RNA, 17 nt, Homo sapiens
cgcucgcuuccgcaucc

SEQ ID NO: 43181 - RNA, 11 nt, Homo sapiens
cgcucggccug

SEQ ID NO: 43182 - RNA, 14 nt, Homo sapiens
cgcucggccugcuc

SEQ ID NO: 43183 - RNA, 15 nt, Homo sapiens
cgcucggccugcucg

SEQ ID NO: 43184 - RNA, 18 nt, Homo sapiens
cgcucggccugcucgccc

SEQ ID NO: 43185 - RNA, 19 nt, Homo sapiens
cgcucggccugcucgccca

SEQ ID NO: 43186 - RNA, 14 nt, Homo sapiens
cgcucugggucgcc

SEQ ID NO: 43187 - RNA, 17 nt, Homo sapiens
cgcucugggucgccggc

SEQ ID NO: 43188 - RNA, 18 nt, Homo sapiens
cgcucugggucgccggca

SEQ ID NO: 43189 - RNA, 19 nt, Homo sapiens
cgcucugggucgccggcau

SEQ ID NO: 43190 - RNA, 20 nt, Homo sapiens
cgcucugggucgccggcauc

SEQ ID NO: 43191 - RNA, 11 nt, Homo sapiens
cgcugcgcgcc

SEQ ID NO: 43192 - RNA, 12 nt, Homo sapiens
cgcugcgcgccg

SEQ ID NO: 43193 - RNA, 13 nt, Homo sapiens
cgcugcgcgccgc

SEQ ID NO: 43194 - RNA, 16 nt, Homo sapiens
cgcugcgcgccgcgcu

SEQ ID NO: 43195 - RNA, 19 nt, Homo sapiens
cgcugcgcgccgcgcuccu

SEQ ID NO: 43196 - RNA, 15 nt, Homo sapiens
cgcugcugccguggg

SEQ ID NO: 43197 - RNA, 12 nt, Homo sapiens
cgcuggcugcgc

SEQ ID NO: 43198 - RNA, 13 nt, Homo sapiens
cgcuggcugcgcu

SEQ ID NO: 43199 - RNA, 16 nt, Homo sapiens
cgcuggcugcgcucgg

SEQ ID NO: 43200 - RNA, 19 nt, Homo sapiens
cgcuggcugcgcucggccu

SEQ ID NO: 43201 - RNA, 21 nt, Homo sapiens
cgcuggcugcgcucggccugc

SEQ ID NO: 43202 - RNA, 14 nt, Homo sapiens
cgcuguacgcgagc

SEQ ID NO: 43203 - RNA, 16 nt, Homo sapiens
cgcuguacgcgagcgc

SEQ ID NO: 43204 - RNA, 18 nt, Homo sapiens
cgcuguacgcgagcgcgc

SEQ ID NO: 43205 - RNA, 20 nt, Homo sapiens
cgcuguacgcgagcgcgcgc

SEQ ID NO: 43206 - RNA, 22 nt, Homo sapiens
cgcuguacgcgagcgcgcgcgc

SEQ ID NO: 43207 - RNA, 13 nt, Homo sapiens
cgcuguuccucgc

SEQ ID NO: 43208 - RNA, 16 nt, Homo sapiens
cgcuguuccucgccac

SEQ ID NO: 43209 - RNA, 18 nt, Homo sapiens
cgcuguuccucgccacgc

SEQ ID NO: 43210 - RNA, 21 nt, Homo sapiens
cgcuguuccucgccacgcucu

SEQ ID NO: 43211 - RNA, 23 nt, Homo sapiens
cgcuguuccucgccacgcucugg

SEQ ID NO: 43212 - RNA, 14 nt, Homo sapiens
cgcuuaagcuuuca

SEQ ID NO: 43213 - RNA, 16 nt, Homo sapiens
cgcuuccgcauccuag

SEQ ID NO: 43214 - RNA, 22 nt, Homo sapiens
cgcuuccgcauccuagucucua

SEQ ID NO: 43215 - RNA, 16 nt, Homo sapiens
cgcuuuugauaaucaa

SEQ ID NO: 43216 - RNA, 17 nt, Homo sapiens
cgcuuuugauaaucaac

SEQ ID NO: 43217 - RNA, 13 nt, Homo sapiens
cggaacucaaaua

SEQ ID NO: 43218 - RNA, 11 nt, Homo sapiens
cggaagccaaa

SEQ ID NO: 43219 - RNA, 16 nt, Homo sapiens
cggacgcugcugccgu

SEQ ID NO: 43220 - RNA, 18 nt, Homo sapiens
cggacgcugcugccgugg

SEQ ID NO: 43221 - RNA, 21 nt, Homo sapiens
cggacgcugcugccgugggcc

SEQ ID NO: 43222 - RNA, 13 nt, Homo sapiens
cggacggcuccgg

SEQ ID NO: 43223 - RNA, 16 nt, Homo sapiens
cggacggcuccggacg

SEQ ID NO: 43224 - RNA, 20 nt, Homo sapiens
cggacuccuccgcauccucc

SEQ ID NO: 43225 - RNA, 22 nt, Homo sapiens
cggagaagagcuguucacagcc

SEQ ID NO: 43226 - RNA, 13 nt, Homo sapiens
cggagccuccagc

SEQ ID NO: 43227 - RNA, 15 nt, Homo sapiens
cggagccuccagcug

SEQ ID NO: 43228 - RNA, 16 nt, Homo sapiens
cggagccuccagcugc

SEQ ID NO: 43229 - RNA, 17 nt, Homo sapiens
cggagccuccagcugcc

SEQ ID NO: 43230 - RNA, 20 nt, Homo sapiens
cggagccuccagcugccccg

SEQ ID NO: 43231 - RNA, 21 nt, Homo sapiens
cggagccuccagcugccccgg

SEQ ID NO: 43232 - RNA, 22 nt, Homo sapiens
cggagccuccagcugccccggg

SEQ ID NO: 43233 - RNA, 21 nt, Homo sapiens
cggaucuggggcucugggaua

SEQ ID NO: 43234 - RNA, 23 nt, Homo sapiens
cggauugagaaggagcucccagg

SEQ ID NO: 43235 - RNA, 16 nt, Homo sapiens
cggcagggaaauguau

SEQ ID NO: 43236 - RNA, 17 nt, Homo sapiens
cggcccugugcggccug

SEQ ID NO: 43237 - RNA, 21 nt, Homo sapiens
cggcccugugcggccuggucu

SEQ ID NO: 43238 - RNA, 11 nt, Homo sapiens
cggccgcgcug

SEQ ID NO: 43239 - RNA, 13 nt, Homo sapiens
cggccgcgcugcg

SEQ ID NO: 43240 - RNA, 14 nt, Homo sapiens
cggccgcgcugcgc

SEQ ID NO: 43241 - RNA, 16 nt, Homo sapiens
cggccgcgcugcgcgc

SEQ ID NO: 43242 - RNA, 17 nt, Homo sapiens
cggccgcgcugcgcgcc

SEQ ID NO: 43243 - RNA, 19 nt, Homo sapiens
cggccgcgcugcgcgccgc

SEQ ID NO: 43244 - RNA, 12 nt, Homo sapiens
cggccggcgcgc

SEQ ID NO: 43245 - RNA, 14 nt, Homo sapiens
cggccggcgcgcuc

SEQ ID NO: 43246 - RNA, 15 nt, Homo sapiens
cggccggcgcgcuca

SEQ ID NO: 43247 - RNA, 16 nt, Homo sapiens
cggccggcgcgcucau

SEQ ID NO: 43248 - RNA, 13 nt, Homo sapiens
cggccugcucgcc

SEQ ID NO: 43249 - RNA, 15 nt, Homo sapiens
cggccugcucgccca

SEQ ID NO: 43250 - RNA, 20 nt, Homo sapiens
cggccuggucuaccuguucg

SEQ ID NO: 43251 - RNA, 21 nt, Homo sapiens
cggccuggucuaccuguucgc

SEQ ID NO: 43252 - RNA, 24 nt, Homo sapiens
cggccuggucuaccuguucgcgcg

SEQ ID NO: 43253 - RNA, 16 nt, Homo sapiens
cggcgcgcucauccca

SEQ ID NO: 43254 - RNA, 10 nt, Homo sapiens
cggcggcccu

SEQ ID NO: 43255 - RNA, 11 nt, Homo sapiens
cggcggcccug

SEQ ID NO: 43256 - RNA, 12 nt, Homo sapiens
cggcggcccugu

SEQ ID NO: 43257 - RNA, 13 nt, Homo sapiens
cggcggcccugug

SEQ ID NO: 43258 - RNA, 15 nt, Homo sapiens
cggcggcccugugcg

SEQ ID NO: 43259 - RNA, 16 nt, Homo sapiens
cggcggcccugugcgg

SEQ ID NO: 43260 - RNA, 20 nt, Homo sapiens
cggcggcccugugcggccug

SEQ ID NO: 43261 - RNA, 22 nt, Homo sapiens
cggcggcccugugcggccuggu

SEQ ID NO: 43262 - RNA, 16 nt, Homo sapiens
cggcgggagggcgcgg

SEQ ID NO: 43263 - RNA, 17 nt, Homo sapiens
cggcgggagggcgcggg

SEQ ID NO: 43264 - RNA, 14 nt, Homo sapiens
cggcuccggacgcu

SEQ ID NO: 43265 - RNA, 16 nt, Homo sapiens
cggcuccggacgcugc

SEQ ID NO: 43266 - RNA, 17 nt, Homo sapiens
cggcuccggacgcugcu

SEQ ID NO: 43267 - RNA, 21 nt, Homo sapiens
cggcuccggacgcugcugccg

SEQ ID NO: 43268 - RNA, 16 nt, Homo sapiens
cgggaaagaagagccg

SEQ ID NO: 43269 - RNA, 20 nt, Homo sapiens
cgggaaagaagagccggagc

SEQ ID NO: 43270 - RNA, 22 nt, Homo sapiens
cgggaaagaagagccggagccu

SEQ ID NO: 43271 - RNA, 15 nt, Homo sapiens
cgggacacaggcucc

SEQ ID NO: 43272 - RNA, 22 nt, Homo sapiens
cgggacacaggcuccaaacugg

SEQ ID NO: 43273 - RNA, 20 nt, Homo sapiens
cgggaggcagagguugcagu

SEQ ID NO: 43274 - RNA, 13 nt, Homo sapiens
cgggagggcgcgg

SEQ ID NO: 43275 - RNA, 14 nt, Homo sapiens
cgggagggcgcggg

SEQ ID NO: 43276 - RNA, 17 nt, Homo sapiens
cgggagggcgcggggcg

SEQ ID NO: 43277 - RNA, 18 nt, Homo sapiens
cgggagggcgcggggcgg

SEQ ID NO: 43278 - RNA, 19 nt, Homo sapiens
cgggagggcgcggggcggg

SEQ ID NO: 43279 - RNA, 21 nt, Homo sapiens
cgggagggcgcggggcgggga

SEQ ID NO: 43280 - RNA, 12 nt, Homo sapiens
cgggaguggcgc

SEQ ID NO: 43281 - RNA, 19 nt, Homo sapiens
cgggaguggcgcgcgccac

SEQ ID NO: 43282 - RNA, 21 nt, Homo sapiens
cgggaguggcgcgcgccacca

SEQ ID NO: 43283 - RNA, 22 nt, Homo sapiens
cgggaguggcgcgcgccaccac

SEQ ID NO: 43284 - RNA, 13 nt, Homo sapiens
cgggcaugguggc

SEQ ID NO: 43285 - RNA, 12 nt, Homo sapiens
cgggccgacgga

SEQ ID NO: 43286 - RNA, 15 nt, Homo sapiens
cgggccgacggagcc

SEQ ID NO: 43287 - RNA, 16 nt, Homo sapiens
cgggccgacggagccg

SEQ ID NO: 43288 - RNA, 17 nt, Homo sapiens
cgggccgacggagccgg

SEQ ID NO: 43289 - RNA, 18 nt, Homo sapiens
cgggccgacggagccggg

SEQ ID NO: 43290 - RNA, 20 nt, Homo sapiens
cgggccgacggagccgggaa

SEQ ID NO: 43291 - RNA, 21 nt, Homo sapiens
cgggccgacggagccgggaaa

SEQ ID NO: 43292 - RNA, 12 nt, Homo sapiens
cgggcgcggugg

SEQ ID NO: 43293 - RNA, 15 nt, Homo sapiens
cgggcguggugguga

SEQ ID NO: 43294 - RNA, 12 nt, Homo sapiens
cggggagcgagc

SEQ ID NO: 43295 - RNA, 14 nt, Homo sapiens
cggggagcgagccc

SEQ ID NO: 43296 - RNA, 19 nt, Homo sapiens
cggggagcgagccccaggc

SEQ ID NO: 43297 - RNA, 21 nt, Homo sapiens
cggggagcgagccccaggcgg

SEQ ID NO: 43298 - RNA, 22 nt, Homo sapiens
cggggagcgagccccaggcggg

SEQ ID NO: 43299 - RNA, 14 nt, Homo sapiens
cggggaggggcgcu

SEQ ID NO: 43300 - RNA, 18 nt, Homo sapiens
cggggaggggcgcucgcu

SEQ ID NO: 43301 - RNA, 20 nt, Homo sapiens
cggggaggggcgcucgcuuc

SEQ ID NO: 43302 - RNA, 14 nt, Homo sapiens
cggggcggggagcg

SEQ ID NO: 43303 - RNA, 16 nt, Homo sapiens
cggggcggggagcgag

SEQ ID NO: 43304 - RNA, 17 nt, Homo sapiens
cggggcggggagcgagc

SEQ ID NO: 43305 - RNA, 18 nt, Homo sapiens
cggggcggggagcgagcc

SEQ ID NO: 43306 - RNA, 19 nt, Homo sapiens
cgggguuugccaugcuggc

SEQ ID NO: 43307 - RNA, 21 nt, Homo sapiens
cgggguuugccaugcuggcca

SEQ ID NO: 43308 - RNA, 13 nt, Homo sapiens
cggguccgggucg

SEQ ID NO: 43309 - RNA, 15 nt, Homo sapiens
cggguccgggucgca

SEQ ID NO: 43310 - RNA, 22 nt, Homo sapiens
cgggucgcaggaccaucccggc

SEQ ID NO: 43311 - RNA, 14 nt, Homo sapiens
cgguccuugcugca

SEQ ID NO: 43312 - RNA, 16 nt, Homo sapiens
cgguuuaaugggcaca

SEQ ID NO: 43313 - RNA, 12 nt, Homo sapiens
cguacacauuuu

SEQ ID NO: 43314 - RNA, 16 nt, Homo sapiens
cguauugcauuuaauu

SEQ ID NO: 43315 - RNA, 17 nt, Homo sapiens
cguccccagagcuacag

SEQ ID NO: 43316 - RNA, 12 nt, Homo sapiens
cguccuuccacu

SEQ ID NO: 43317 - RNA, 14 nt, Homo sapiens
cguccuuccacuuc

SEQ ID NO: 43318 - RNA, 19 nt, Homo sapiens
cgucucccaaagugcuggg

SEQ ID NO: 43319 - RNA, 21 nt, Homo sapiens
cgugaccugacagcccaaggg

SEQ ID NO: 43320 - RNA, 13 nt, Homo sapiens
cgugacuggccug

SEQ ID NO: 43321 - RNA, 19 nt, Homo sapiens
cgugacuggccugcuggau

SEQ ID NO: 43322 - RNA, 21 nt, Homo sapiens
cgugacuggccugcuggaugu

SEQ ID NO: 43323 - RNA, 13 nt, Homo sapiens
cgugagccaccaa

SEQ ID NO: 43324 - RNA, 14 nt, Homo sapiens
cgugagccaccaaa

SEQ ID NO: 43325 - RNA, 15 nt, Homo sapiens
cgugagccaccaaac

SEQ ID NO: 43326 - RNA, 17 nt, Homo sapiens
cgugagccaccaaaccc

SEQ ID NO: 43327 - RNA, 21 nt, Homo sapiens
cgugagccaccaaacccggcc

SEQ ID NO: 43328 - RNA, 16 nt, Homo sapiens
cgugauuuugcuguag

SEQ ID NO: 43329 - RNA, 9 nt, Homo sapiens
cgugcaaua

SEQ ID NO: 43330 - RNA, 17 nt, Homo sapiens
cgugcaggcagcaggau

SEQ ID NO: 43331 - RNA, 16 nt, Homo sapiens
cgugggacagucaccu

SEQ ID NO: 43332 - RNA, 14 nt, Homo sapiens
cgugggccugagac

SEQ ID NO: 43333 - RNA, 12 nt, Homo sapiens
cgugugccugag

SEQ ID NO: 43334 - RNA, 15 nt, Homo sapiens
cguugcuggggggga

SEQ ID NO: 43335 - RNA, 14 nt, Homo sapiens
cguugugcauuugg

SEQ ID NO: 43336 - RNA, 19 nt, Homo sapiens
cguuucuaugacacaugca

SEQ ID NO: 43337 - RNA, 16 nt, Homo sapiens
cguuugugauugccau

SEQ ID NO: 43338 - RNA, 18 nt, Homo sapiens
cuaaaaggccugucccug

SEQ ID NO: 43339 - RNA, 14 nt, Homo sapiens
cuaaaauguucuaa

SEQ ID NO: 43340 - RNA, 16 nt, Homo sapiens
cuaaacauguauguaa

SEQ ID NO: 43341 - RNA, 17 nt, Homo sapiens
cuaaacauguauguaaa

SEQ ID NO: 43342 - RNA, 16 nt, Homo sapiens
cuaaaguaucuguauu

SEQ ID NO: 43343 - RNA, 17 nt, Homo sapiens
cuaaaucaauucuauua

SEQ ID NO: 43344 - RNA, 17 nt, Homo sapiens
cuaaccagccuggucaa

SEQ ID NO: 43345 - RNA, 20 nt, Homo sapiens
cuaaccucauuccccaacca

SEQ ID NO: 43346 - RNA, 24 nt, Homo sapiens
cuaacucagaaacaucaguuacuc

SEQ ID NO: 43347 - RNA, 22 nt, Homo sapiens
cuaaguaaaaccacagcaguug

SEQ ID NO: 43348 - RNA, 14 nt, Homo sapiens
cuaagucccugcug

SEQ ID NO: 43349 - RNA, 16 nt, Homo sapiens
cuaauaaaaaggugac

SEQ ID NO: 43350 - RNA, 18 nt, Homo sapiens
cuaauaaaauacauacua

SEQ ID NO: 43351 - RNA, 17 nt, Homo sapiens
cuaauguguaagacaaa

SEQ ID NO: 43352 - RNA, 13 nt, Homo sapiens
cuaauuaggcaag

SEQ ID NO: 43353 - RNA, 19 nt, Homo sapiens
cuacaaaauauagcuuuca

SEQ ID NO: 43354 - RNA, 20 nt, Homo sapiens
cuacaaaauauagcuuucau

SEQ ID NO: 43355 - RNA, 19 nt, Homo sapiens
cuacaauuguaaacuaguu

SEQ ID NO: 43356 - RNA, 19 nt, Homo sapiens
cuacagccaggcggcugga

SEQ ID NO: 43357 - RNA, 19 nt, Homo sapiens
cuacaguguacagucuugu

SEQ ID NO: 43358 - RNA, 16 nt, Homo sapiens
cuacauacuauggaau

SEQ ID NO: 43359 - RNA, 16 nt, Homo sapiens
cuaccaaaaaucucaa

SEQ ID NO: 43360 - RNA, 16 nt, Homo sapiens
cuaccagcccuacacc

SEQ ID NO: 43361 - RNA, 18 nt, Homo sapiens
cuaccagcccuacaccau

SEQ ID NO: 43362 - RNA, 12 nt, Homo sapiens
cuaccucuccag

SEQ ID NO: 43363 - RNA, 18 nt, Homo sapiens
cuaccuguucgcgcgccu

SEQ ID NO: 43364 - RNA, 19 nt, Homo sapiens
cuaccuguucgcgcgccuc

SEQ ID NO: 43365 - RNA, 20 nt, Homo sapiens
cuaccuguucgcgcgccucc

SEQ ID NO: 43366 - RNA, 22 nt, Homo sapiens
cuaccuguucgcgcgccuccgc

SEQ ID NO: 43367 - RNA, 10 nt, Homo sapiens
cuacgcgcgc

SEQ ID NO: 43368 - RNA, 11 nt, Homo sapiens
cuacgcgcgcu

SEQ ID NO: 43369 - RNA, 13 nt, Homo sapiens
cuacgcgcgcucc

SEQ ID NO: 43370 - RNA, 17 nt, Homo sapiens
cuacgcgcgcuccgcgc

SEQ ID NO: 43371 - RNA, 23 nt, Homo sapiens
cuacgcgcgcuccgcgcagcuca

SEQ ID NO: 43372 - RNA, 16 nt, Homo sapiens
cuacucuguuccuuca

SEQ ID NO: 43373 - RNA, 23 nt, Homo sapiens
cuacucuguuccuucacauccug

SEQ ID NO: 43374 - RNA, 18 nt, Homo sapiens
cuacuguaauuugugaua

SEQ ID NO: 43375 - RNA, 12 nt, Homo sapiens
cuacuugcacac

SEQ ID NO: 43376 - RNA, 20 nt, Homo sapiens
cuacuugggaggcugagaug

SEQ ID NO: 43377 - RNA, 19 nt, Homo sapiens
cuacuugggaggcugaggc

SEQ ID NO: 43378 - RNA, 20 nt, Homo sapiens
cuacuugggaggcugaggca

SEQ ID NO: 43379 - RNA, 22 nt, Homo sapiens
cuagaauacuaauaaaauacau

SEQ ID NO: 43380 - RNA, 15 nt, Homo sapiens
cuagaauucacucca

SEQ ID NO: 43381 - RNA, 16 nt, Homo sapiens
cuagaauuugauaugu

SEQ ID NO: 43382 - RNA, 13 nt, Homo sapiens
cuagaguuuagcu

SEQ ID NO: 43383 - RNA, 13 nt, Homo sapiens
cuagauacuguau

SEQ ID NO: 43384 - RNA, 18 nt, Homo sapiens
cuagauacuguaucauga

SEQ ID NO: 43385 - RNA, 14 nt, Homo sapiens
cuagauagucaaua

SEQ ID NO: 43386 - RNA, 20 nt, Homo sapiens
cuagcaaauguuaugcauaa

SEQ ID NO: 43387 - RNA, 15 nt, Homo sapiens
cuagcccuuacgucc

SEQ ID NO: 43388 - RNA, 20 nt, Homo sapiens
cuagcccuuacguccuucca

SEQ ID NO: 43389 - RNA, 15 nt, Homo sapiens
cuagcuaauaucaau

SEQ ID NO: 43390 - RNA, 20 nt, Homo sapiens
cuaggaaauauuuauuuuaa

SEQ ID NO: 43391 - RNA, 12 nt, Homo sapiens
cuaggccgggcg

SEQ ID NO: 43392 - RNA, 13 nt, Homo sapiens
cuaggccgggcgc

SEQ ID NO: 43393 - RNA, 18 nt, Homo sapiens
cuaggccgggcgcggugg

SEQ ID NO: 43394 - RNA, 17 nt, Homo sapiens
cuaggggggucagccag

SEQ ID NO: 43395 - RNA, 19 nt, Homo sapiens
cuaggggggucagccagcc

SEQ ID NO: 43396 - RNA, 15 nt, Homo sapiens
cuaggugcugcagcc

SEQ ID NO: 43397 - RNA, 23 nt, Homo sapiens
cuaguaauuggaaaggcagcucu

SEQ ID NO: 43398 - RNA, 17 nt, Homo sapiens
cuagucucuaucauuaa

SEQ ID NO: 43399 - RNA, 13 nt, Homo sapiens
cuagugaccgaga

SEQ ID NO: 43400 - RNA, 14 nt, Homo sapiens
cuaguuguaauuuu

SEQ ID NO: 43401 - RNA, 23 nt, Homo sapiens
cuaguuguaauuuuuuuguggga

SEQ ID NO: 43402 - RNA, 14 nt, Homo sapiens
cuaguuucccuugc

SEQ ID NO: 43403 - RNA, 18 nt, Homo sapiens
cuauaaaacuaggugcug

SEQ ID NO: 43404 - RNA, 18 nt, Homo sapiens
cuauaaaccgaacugaug

SEQ ID NO: 43405 - RNA, 23 nt, Homo sapiens
cuauaggugcuacaaaaacacag

SEQ ID NO: 43406 - RNA, 22 nt, Homo sapiens
cuauauccugugacugucucac

SEQ ID NO: 43407 - RNA, 13 nt, Homo sapiens
cuauauuaucaug

SEQ ID NO: 43408 - RNA, 15 nt, Homo sapiens
cuauauuguuugcua

SEQ ID NO: 43409 - RNA, 23 nt, Homo sapiens
cuaucagcauuuuacuacuuuaa

SEQ ID NO: 43410 - RNA, 19 nt, Homo sapiens
cuaucccaaccucucccaa

SEQ ID NO: 43411 - RNA, 14 nt, Homo sapiens
cuaucgccaucaca

SEQ ID NO: 43412 - RNA, 13 nt, Homo sapiens
cuaucucauuucc

SEQ ID NO: 43413 - RNA, 21 nt, Homo sapiens
cuauguagaauauauuuccuu

SEQ ID NO: 43414 - RNA, 14 nt, Homo sapiens
cuaugugauuacaa

SEQ ID NO: 43415 - RNA, 21 nt, Homo sapiens
cuauguuaauauuuuaugugu

SEQ ID NO: 43416 - RNA, 22 nt, Homo sapiens
cuauguucuaagaagugaaaau

SEQ ID NO: 43417 - RNA, 17 nt, Homo sapiens
cuauguuguugcacuuu

SEQ ID NO: 43418 - RNA, 15 nt, Homo sapiens
cuauuacgugcaaua

SEQ ID NO: 43419 - RNA, 16 nt, Homo sapiens
cuauuacgugcaauac

SEQ ID NO: 43420 - RNA, 18 nt, Homo sapiens
cuauuacgugcaauacuu

SEQ ID NO: 43421 - RNA, 23 nt, Homo sapiens
cuauuauagaauggaacucaagg

SEQ ID NO: 43422 - RNA, 13 nt, Homo sapiens
cuauuauauucau

SEQ ID NO: 43423 - RNA, 14 nt, Homo sapiens
cuauuauauucauu

SEQ ID NO: 43424 - RNA, 15 nt, Homo sapiens
cuauuauauucauuc

SEQ ID NO: 43425 - RNA, 18 nt, Homo sapiens
cuauuauauucauucuuu

SEQ ID NO: 43426 - RNA, 17 nt, Homo sapiens
cuauucaaacagucuca

SEQ ID NO: 43427 - RNA, 21 nt, Homo sapiens
cuauugugcuuucuaucuaau

SEQ ID NO: 43428 - RNA, 16 nt, Homo sapiens
cuauuuaaagacaaag

SEQ ID NO: 43429 - RNA, 22 nt, Homo sapiens
cuauuuaauuauuucacuuuag

SEQ ID NO: 43430 - RNA, 20 nt, Homo sapiens
cuauuuauugcugaaugacu

SEQ ID NO: 43431 - RNA, 21 nt, Homo sapiens
cuauuuauugcugaaugacua

SEQ ID NO: 43432 - RNA, 22 nt, Homo sapiens
cuauuuauugcugaaugacuac

SEQ ID NO: 43433 - RNA, 19 nt, Homo sapiens
cuauuuuuuuucuguuaua

SEQ ID NO: 43434 - RNA, 18 nt, Homo sapiens
cucaaaacugcacuguca

SEQ ID NO: 43435 - RNA, 18 nt, Homo sapiens
cucaaaauaccaugccau

SEQ ID NO: 43436 - RNA, 11 nt, Homo sapiens
cucaagccagc

SEQ ID NO: 43437 - RNA, 15 nt, Homo sapiens
cucacaagcacuuuc

SEQ ID NO: 43438 - RNA, 16 nt, Homo sapiens
cucacaagcacuuucc

SEQ ID NO: 43439 - RNA, 17 nt, Homo sapiens
cucaccucucaccuccc

SEQ ID NO: 43440 - RNA, 14 nt, Homo sapiens
cucagaaacaucag

SEQ ID NO: 43441 - RNA, 17 nt, Homo sapiens
cucagaaacaucaguua

SEQ ID NO: 43442 - RNA, 13 nt, Homo sapiens
cucagaaggcaaa

SEQ ID NO: 43443 - RNA, 13 nt, Homo sapiens
cucaggcuggcac

SEQ ID NO: 43444 - RNA, 15 nt, Homo sapiens
cucaggcuggcaccg

SEQ ID NO: 43445 - RNA, 16 nt, Homo sapiens
cucaggcuggcaccgc

SEQ ID NO: 43446 - RNA, 20 nt, Homo sapiens
cucaggcuggcaccgcugua

SEQ ID NO: 43447 - RNA, 21 nt, Homo sapiens
cucaggcuggcaccgcuguac

SEQ ID NO: 43448 - RNA, 22 nt, Homo sapiens
cucaggcuggcaccgcuguacg

SEQ ID NO: 43449 - RNA, 23 nt, Homo sapiens
cucaggcuggcaccgcuguacgc

SEQ ID NO: 43450 - RNA, 20 nt, Homo sapiens
cucaggggccaacuaggcag

SEQ ID NO: 43451 - RNA, 19 nt, Homo sapiens
cucagugucaaugcagccc

SEQ ID NO: 43452 - RNA, 20 nt, Homo sapiens
cucagugucaaugcagcccc

SEQ ID NO: 43453 - RNA, 15 nt, Homo sapiens
cucaguguccucauc

SEQ ID NO: 43454 - RNA, 21 nt, Homo sapiens
cucaguugcagcccugcugcu

SEQ ID NO: 43455 - RNA, 15 nt, Homo sapiens
cucauccacuuucca

SEQ ID NO: 43456 - RNA, 15 nt, Homo sapiens
cucaucccacccgcc

SEQ ID NO: 43457 - RNA, 13 nt, Homo sapiens
cucaucugugauu

SEQ ID NO: 43458 - RNA, 11 nt, Homo sapiens
cucaugcugcc

SEQ ID NO: 43459 - RNA, 14 nt, Homo sapiens
cucauggaauugga

SEQ ID NO: 43460 - RNA, 22 nt, Homo sapiens
cucauggaauuggagcucgugg

SEQ ID NO: 43461 - RNA, 23 nt, Homo sapiens
cucauggaauuggagcucguggg

SEQ ID NO: 43462 - RNA, 20 nt, Homo sapiens
cucaugggggugacaagcuu

SEQ ID NO: 43463 - RNA, 18 nt, Homo sapiens
cucauuccccaaccacuu

SEQ ID NO: 43464 - RNA, 18 nt, Homo sapiens
cucauugcaaccuccacc

SEQ ID NO: 43465 - RNA, 19 nt, Homo sapiens
cucauugcaaccuccaccu

SEQ ID NO: 43466 - RNA, 19 nt, Homo sapiens
cucauuuauuuccauauua

SEQ ID NO: 43467 - RNA, 15 nt, Homo sapiens
cucauuuccaagcaa

SEQ ID NO: 43468 - RNA, 22 nt, Homo sapiens
cucauuuccuauguaacugcau

SEQ ID NO: 43469 - RNA, 23 nt, Homo sapiens
cucauuuccuauguaacugcauu

SEQ ID NO: 43470 - RNA, 21 nt, Homo sapiens
cucauuuuuguuuucauuauc

SEQ ID NO: 43471 - RNA, 23 nt, Homo sapiens
cucauuuuuguuuucauuaucuc

SEQ ID NO: 43472 - RNA, 17 nt, Homo sapiens
cuccaaaaucggaucug

SEQ ID NO: 43473 - RNA, 22 nt, Homo sapiens
cuccaaaccacuuuuugcagcu

SEQ ID NO: 43474 - RNA, 16 nt, Homo sapiens
cuccaauuaaggauuu

SEQ ID NO: 43475 - RNA, 13 nt, Homo sapiens
cuccacauccugu

SEQ ID NO: 43476 - RNA, 15 nt, Homo sapiens
cuccaccuucugggu

SEQ ID NO: 43477 - RNA, 14 nt, Homo sapiens
cuccagccugagcg

SEQ ID NO: 43478 - RNA, 11 nt, Homo sapiens
cuccagccugg

SEQ ID NO: 43479 - RNA, 12 nt, Homo sapiens
cuccagccuggg

SEQ ID NO: 43480 - RNA, 16 nt, Homo sapiens
cuccagccugggugac

SEQ ID NO: 43481 - RNA, 17 nt, Homo sapiens
cuccagccugggugaca

SEQ ID NO: 43482 - RNA, 14 nt, Homo sapiens
cuccagcugccccg

SEQ ID NO: 43483 - RNA, 15 nt, Homo sapiens
cuccagcugccccgg

SEQ ID NO: 43484 - RNA, 18 nt, Homo sapiens
cuccagcugccccgggga

SEQ ID NO: 43485 - RNA, 21 nt, Homo sapiens
cuccaugaauaucaguuauuu

SEQ ID NO: 43486 - RNA, 17 nt, Homo sapiens
cuccaugaucccaccuc

SEQ ID NO: 43487 - RNA, 13 nt, Homo sapiens
cuccauggcccug

SEQ ID NO: 43488 - RNA, 14 nt, Homo sapiens
cuccauggcccugc

SEQ ID NO: 43489 - RNA, 15 nt, Homo sapiens
cucccaacgucccua

SEQ ID NO: 43490 - RNA, 17 nt, Homo sapiens
cucccaacuauaaaacu

SEQ ID NO: 43491 - RNA, 23 nt, Homo sapiens
cucccauucacagauaccucucu

SEQ ID NO: 43492 - RNA, 11 nt, Homo sapiens
cucccauucag

SEQ ID NO: 43493 - RNA, 12 nt, Homo sapiens
cucccauucagg

SEQ ID NO: 43494 - RNA, 12 nt, Homo sapiens
cucccggccgcg

SEQ ID NO: 43495 - RNA, 13 nt, Homo sapiens
cucccggccgcgc

SEQ ID NO: 43496 - RNA, 17 nt, Homo sapiens
cucccggccgcgcugcg

SEQ ID NO: 43497 - RNA, 18 nt, Homo sapiens
cucccggccgcgcugcgc

SEQ ID NO: 43498 - RNA, 19 nt, Homo sapiens
cucccggccgcgcugcgcg

SEQ ID NO: 43499 - RNA, 20 nt, Homo sapiens
cucccggccgcgcugcgcgc

SEQ ID NO: 43500 - RNA, 23 nt, Homo sapiens
cucccggccgcgcugcgcgccgc

SEQ ID NO: 43501 - RNA, 12 nt, Homo sapiens
cuccgcgcagcu

SEQ ID NO: 43502 - RNA, 14 nt, Homo sapiens
cuccgcgcagcuca

SEQ ID NO: 43503 - RNA, 20 nt, Homo sapiens
cuccgcgcagcucaggcugg

SEQ ID NO: 43504 - RNA, 17 nt, Homo sapiens
cuccgcuacuuccaggg

SEQ ID NO: 43505 - RNA, 21 nt, Homo sapiens
cuccgcuacuuccagggcuac

SEQ ID NO: 43506 - RNA, 13 nt, Homo sapiens
cuccggacgcugc

SEQ ID NO: 43507 - RNA, 15 nt, Homo sapiens
cuccggacgcugcug

SEQ ID NO: 43508 - RNA, 17 nt, Homo sapiens
cuccggacgcugcugcc

SEQ ID NO: 43509 - RNA, 19 nt, Homo sapiens
cuccggacgcugcugccgu

SEQ ID NO: 43510 - RNA, 20 nt, Homo sapiens
cuccggacgcugcugccgug

SEQ ID NO: 43511 - RNA, 22 nt, Homo sapiens
cuccugagacacaugggugcua

SEQ ID NO: 43512 - RNA, 20 nt, Homo sapiens
cuccugccuaagugcagccc

SEQ ID NO: 43513 - RNA, 21 nt, Homo sapiens
cuccugccuaagugcagcccc

SEQ ID NO: 43514 - RNA, 15 nt, Homo sapiens
cuccugcuacucugu

SEQ ID NO: 43515 - RNA, 23 nt, Homo sapiens
cuccuucauggcaggcaucgcca

SEQ ID NO: 43516 - RNA, 13 nt, Homo sapiens
cuccuuguguuac

SEQ ID NO: 43517 - RNA, 13 nt, Homo sapiens
cucgaacugcugg

SEQ ID NO: 43518 - RNA, 20 nt, Homo sapiens
cucgaacugcuggauucaag

SEQ ID NO: 43519 - RNA, 18 nt, Homo sapiens
cucgaggcccuagcauuu

SEQ ID NO: 43520 - RNA, 12 nt, Homo sapiens
cucgccacgcuc

SEQ ID NO: 43521 - RNA, 13 nt, Homo sapiens
cucgccacgcucu

SEQ ID NO: 43522 - RNA, 15 nt, Homo sapiens
cucgccacgcucugg

SEQ ID NO: 43523 - RNA, 19 nt, Homo sapiens
cucgccacgcucugggucg

SEQ ID NO: 43524 - RNA, 22 nt, Homo sapiens
cucgccacgcucugggucgccg

SEQ ID NO: 43525 - RNA, 20 nt, Homo sapiens
cucgcccacuuccucccggc

SEQ ID NO: 43526 - RNA, 21 nt, Homo sapiens
cucgcccacuuccucccggcc

SEQ ID NO: 43527 - RNA, 22 nt, Homo sapiens
cucgcccacuuccucccggccg

SEQ ID NO: 43528 - RNA, 12 nt, Homo sapiens
cucgcuuccgca

SEQ ID NO: 43529 - RNA, 14 nt, Homo sapiens
cucgcuuccgcauc

SEQ ID NO: 43530 - RNA, 20 nt, Homo sapiens
cucgcuuccgcauccuaguc

SEQ ID NO: 43531 - RNA, 21 nt, Homo sapiens
cucggagaagagcuguucaca

SEQ ID NO: 43532 - RNA, 14 nt, Homo sapiens
cucggccugcucgc

SEQ ID NO: 43533 - RNA, 17 nt, Homo sapiens
cucggccugcucgccca

SEQ ID NO: 43534 - RNA, 18 nt, Homo sapiens
cucggccugcucgcccac

SEQ ID NO: 43535 - RNA, 13 nt, Homo sapiens
cucgugggacagu

SEQ ID NO: 43536 - RNA, 14 nt, Homo sapiens
cucgugggacaguc

SEQ ID NO: 43537 - RNA, 19 nt, Homo sapiens
cucgugguaggacuguaga

SEQ ID NO: 43538 - RNA, 20 nt, Homo sapiens
cucgugguaggacuguagaa

SEQ ID NO: 43539 - RNA, 20 nt, Homo sapiens
cucuaacucagaaacaucag

SEQ ID NO: 43540 - RNA, 17 nt, Homo sapiens
cucuaccugcacacugu

SEQ ID NO: 43541 - RNA, 17 nt, Homo sapiens
cucuaggaaauauuuau

SEQ ID NO: 43542 - RNA, 18 nt, Homo sapiens
cucuaggaaauauuuauu

SEQ ID NO: 43543 - RNA, 21 nt, Homo sapiens
cucuaggaaauauuuauuuua

SEQ ID NO: 43544 - RNA, 21 nt, Homo sapiens
cucuauagacucuaggacaua

SEQ ID NO: 43545 - RNA, 22 nt, Homo sapiens
cucuaucauuaaaguucuagug

SEQ ID NO: 43546 - RNA, 17 nt, Homo sapiens
cucuaucccaaccucuc

SEQ ID NO: 43547 - RNA, 12 nt, Homo sapiens
cucuauugccau

SEQ ID NO: 43548 - RNA, 20 nt, Homo sapiens
cucucaguugcagcccugcu

SEQ ID NO: 43549 - RNA, 14 nt, Homo sapiens
cucucucauccacu

SEQ ID NO: 43550 - RNA, 13 nt, Homo sapiens
cucucuuccuccc

SEQ ID NO: 43551 - RNA, 14 nt, Homo sapiens
cucucuuccucccu

SEQ ID NO: 43552 - RNA, 14 nt, Homo sapiens
cucugaaggguaau

SEQ ID NO: 43553 - RNA, 12 nt, Homo sapiens
cucugauaccuc

SEQ ID NO: 43554 - RNA, 21 nt, Homo sapiens
cucugcccauccugccccuga

SEQ ID NO: 43555 - RNA, 14 nt, Homo sapiens
cucuggaagccucu

SEQ ID NO: 43556 - RNA, 21 nt, Homo sapiens
cucuggaagccucuauugcca

SEQ ID NO: 43557 - RNA, 15 nt, Homo sapiens
cucuggcgacaguuu

SEQ ID NO: 43558 - RNA, 23 nt, Homo sapiens
cucuggcgacaguuuuccuucuc

SEQ ID NO: 43559 - RNA, 12 nt, Homo sapiens
cucuggcugcug

SEQ ID NO: 43560 - RNA, 13 nt, Homo sapiens
cucuggcugcugg

SEQ ID NO: 43561 - RNA, 20 nt, Homo sapiens
cucuggcugcugguggcgcu

SEQ ID NO: 43562 - RNA, 22 nt, Homo sapiens
cucuggcugcugguggcgcugg

SEQ ID NO: 43563 - RNA, 16 nt, Homo sapiens
cucugggucgccggca

SEQ ID NO: 43564 - RNA, 18 nt, Homo sapiens
cucugggucgccggcauc

SEQ ID NO: 43565 - RNA, 18 nt, Homo sapiens
cucugggucucagugucc

SEQ ID NO: 43566 - RNA, 13 nt, Homo sapiens
cucugucucaguc

SEQ ID NO: 43567 - RNA, 14 nt, Homo sapiens
cucuucacagucac

SEQ ID NO: 43568 - RNA, 13 nt, Homo sapiens
cucuucugacacu

SEQ ID NO: 43569 - RNA, 14 nt, Homo sapiens
cucuucugacacua

SEQ ID NO: 43570 - RNA, 12 nt, Homo sapiens
cucuugcaauuc

SEQ ID NO: 43571 - RNA, 13 nt, Homo sapiens
cucuuggugccuc

SEQ ID NO: 43572 - RNA, 15 nt, Homo sapiens
cucuuguagcucucu

SEQ ID NO: 43573 - RNA, 22 nt, Homo sapiens
cucuuguagcucucugaccucc

SEQ ID NO: 43574 - RNA, 21 nt, Homo sapiens
cugaaaccccagggcuugugu

SEQ ID NO: 43575 - RNA, 18 nt, Homo sapiens
cugaaagaggaaugaagu

SEQ ID NO: 43576 - RNA, 13 nt, Homo sapiens
cugaacacuccaa

SEQ ID NO: 43577 - RNA, 22 nt, Homo sapiens
cugaaccguuugugauugccau

SEQ ID NO: 43578 - RNA, 21 nt, Homo sapiens
cugaagaagaugguaccacca

SEQ ID NO: 43579 - RNA, 13 nt, Homo sapiens
cugaauacauucu

SEQ ID NO: 43580 - RNA, 20 nt, Homo sapiens
cugaauacauucugcuuuca

SEQ ID NO: 43581 - RNA, 17 nt, Homo sapiens
cugaauuuaaauagcuu

SEQ ID NO: 43582 - RNA, 11 nt, Homo sapiens
cugaauuucuu

SEQ ID NO: 43583 - RNA, 15 nt, Homo sapiens
cugacacuaaaacac

SEQ ID NO: 43584 - RNA, 18 nt, Homo sapiens
cugacacuaaaacaccuc

SEQ ID NO: 43585 - RNA, 18 nt, Homo sapiens
cugacagcccaagggugg

SEQ ID NO: 43586 - RNA, 15 nt, Homo sapiens
cugaccaauauugua

SEQ ID NO: 43587 - RNA, 20 nt, Homo sapiens
cugaccaauauuguacaguu

SEQ ID NO: 43588 - RNA, 21 nt, Homo sapiens
cugaccaauauuguacaguuu

SEQ ID NO: 43589 - RNA, 15 nt, Homo sapiens
cugacccagccccuu

SEQ ID NO: 43590 - RNA, 16 nt, Homo sapiens
cugacccagccccuug

SEQ ID NO: 43591 - RNA, 16 nt, Homo sapiens
cugaccuccuccuuca

SEQ ID NO: 43592 - RNA, 17 nt, Homo sapiens
cugaccuccuccuucau

SEQ ID NO: 43593 - RNA, 16 nt, Homo sapiens
cugacuaauuaggcaa

SEQ ID NO: 43594 - RNA, 11 nt, Homo sapiens
cugacugcuag

SEQ ID NO: 43595 - RNA, 18 nt, Homo sapiens
cugagaaagacuauucaa

SEQ ID NO: 43596 - RNA, 15 nt, Homo sapiens
cugagacacaugggu

SEQ ID NO: 43597 - RNA, 19 nt, Homo sapiens
cugagacacaugggugcua

SEQ ID NO: 43598 - RNA, 18 nt, Homo sapiens
cugagaccaaggcccccg

SEQ ID NO: 43599 - RNA, 19 nt, Homo sapiens
cugagaccaaggcccccgg

SEQ ID NO: 43600 - RNA, 23 nt, Homo sapiens
cugagaccaaggcccccgggccg

SEQ ID NO: 43601 - RNA, 12 nt, Homo sapiens
cugagaccagcc

SEQ ID NO: 43602 - RNA, 13 nt, Homo sapiens
cugagaccagcca

SEQ ID NO: 43603 - RNA, 14 nt, Homo sapiens
cugagaccagccaa

SEQ ID NO: 43604 - RNA, 15 nt, Homo sapiens
cugagaccagccaac

SEQ ID NO: 43605 - RNA, 18 nt, Homo sapiens
cugagaccagccaaccug

SEQ ID NO: 43606 - RNA, 15 nt, Homo sapiens
cugagagugaacaaa

SEQ ID NO: 43607 - RNA, 13 nt, Homo sapiens
cugagcaggauuu

SEQ ID NO: 43608 - RNA, 19 nt, Homo sapiens
cugagcagucagaagaccu

SEQ ID NO: 43609 - RNA, 18 nt, Homo sapiens
cugagcccggaaacucca

SEQ ID NO: 43610 - RNA, 19 nt, Homo sapiens
cugaggagccugcaacaug

SEQ ID NO: 43611 - RNA, 22 nt, Homo sapiens
cugaggagccugcaacaugcca

SEQ ID NO: 43612 - RNA, 19 nt, Homo sapiens
cugaguacguugugcauuu

SEQ ID NO: 43613 - RNA, 12 nt, Homo sapiens
cugauaccucaa

SEQ ID NO: 43614 - RNA, 23 nt, Homo sapiens
cugauauauguguuuuucacauu

SEQ ID NO: 43615 - RNA, 18 nt, Homo sapiens
cugauaugggucuugaua

SEQ ID NO: 43616 - RNA, 21 nt, Homo sapiens
cugauaugggucuugauaaau

SEQ ID NO: 43617 - RNA, 22 nt, Homo sapiens
cugauaugggucuugauaaaug

SEQ ID NO: 43618 - RNA, 22 nt, Homo sapiens
cugaugaaaacauagcaucuca

SEQ ID NO: 43619 - RNA, 13 nt, Homo sapiens
cugauuaaaccaa

SEQ ID NO: 43620 - RNA, 17 nt, Homo sapiens
cugcaacuacuauccaa

SEQ ID NO: 43621 - RNA, 22 nt, Homo sapiens
cugcaagcuuuucaaaauugga

SEQ ID NO: 43622 - RNA, 21 nt, Homo sapiens
cugcaaucugagccagugcuu

SEQ ID NO: 43623 - RNA, 21 nt, Homo sapiens
cugcacacuguccuauuauau

SEQ ID NO: 43624 - RNA, 18 nt, Homo sapiens
cugcacugucaagaugau

SEQ ID NO: 43625 - RNA, 20 nt, Homo sapiens
cugcagaagacaguauggca

SEQ ID NO: 43626 - RNA, 12 nt, Homo sapiens
cugcaucagcug

SEQ ID NO: 43627 - RNA, 20 nt, Homo sapiens
cugcauugagaacugcauau

SEQ ID NO: 43628 - RNA, 16 nt, Homo sapiens
cugccaauauccuaau

SEQ ID NO: 43629 - RNA, 20 nt, Homo sapiens
cugccaucauuuacuuuuaa

SEQ ID NO: 43630 - RNA, 16 nt, Homo sapiens
cugccccggggagggg

SEQ ID NO: 43631 - RNA, 20 nt, Homo sapiens
cugccccggggaggggcgcu

SEQ ID NO: 43632 - RNA, 12 nt, Homo sapiens
cugccccugagc

SEQ ID NO: 43633 - RNA, 14 nt, Homo sapiens
cugccccugagccc

SEQ ID NO: 43634 - RNA, 15 nt, Homo sapiens
cugccccugagccca

SEQ ID NO: 43635 - RNA, 19 nt, Homo sapiens
cugcccugaaagucccaga

SEQ ID NO: 43636 - RNA, 15 nt, Homo sapiens
cugccgugggccuga

SEQ ID NO: 43637 - RNA, 17 nt, Homo sapiens
cugccgugggccugaga

SEQ ID NO: 43638 - RNA, 18 nt, Homo sapiens
cugccgugggccugagac

SEQ ID NO: 43639 - RNA, 18 nt, Homo sapiens
cugccuaagugcagcccc

SEQ ID NO: 43640 - RNA, 20 nt, Homo sapiens
cugccucagguguccgcuau

SEQ ID NO: 43641 - RNA, 23 nt, Homo sapiens
cugccucagguguccgcuaucca

SEQ ID NO: 43642 - RNA, 18 nt, Homo sapiens
cugccucuaaaaggccug

SEQ ID NO: 43643 - RNA, 23 nt, Homo sapiens
cugccucucucauccacuuucca

SEQ ID NO: 43644 - RNA, 21 nt, Homo sapiens
cugccuggacuuggccccugc

SEQ ID NO: 43645 - RNA, 20 nt, Homo sapiens
cugccuuguuuaauguuaau

SEQ ID NO: 43646 - RNA, 13 nt, Homo sapiens
cugcgcgccgcgc

SEQ ID NO: 43647 - RNA, 15 nt, Homo sapiens
cugcgcgccgcgcuc

SEQ ID NO: 43648 - RNA, 17 nt, Homo sapiens
cugcgcgccgcgcuccu

SEQ ID NO: 43649 - RNA, 18 nt, Homo sapiens
cugcgcgccgcgcuccuc

SEQ ID NO: 43650 - RNA, 19 nt, Homo sapiens
cugcuaguuuauauagaaa

SEQ ID NO: 43651 - RNA, 20 nt, Homo sapiens
cugcucgcccacuuccuccc

SEQ ID NO: 43652 - RNA, 22 nt, Homo sapiens
cugcucgcccacuuccucccgg

SEQ ID NO: 43653 - RNA, 23 nt, Homo sapiens
cugcucgcccacuuccucccggc

SEQ ID NO: 43654 - RNA, 18 nt, Homo sapiens
cugcugaaacaacaaaua

SEQ ID NO: 43655 - RNA, 15 nt, Homo sapiens
cugcugcccuucccc

SEQ ID NO: 43656 - RNA, 17 nt, Homo sapiens
cugcugccgugggccug

SEQ ID NO: 43657 - RNA, 19 nt, Homo sapiens
cugcugccgugggccugag

SEQ ID NO: 43658 - RNA, 21 nt, Homo sapiens
cugcugccugccuggacuugg

SEQ ID NO: 43659 - RNA, 10 nt, Homo sapiens
cugcugcugc

SEQ ID NO: 43660 - RNA, 20 nt, Homo sapiens
cugcuggauguggagggggc

SEQ ID NO: 43661 - RNA, 18 nt, Homo sapiens
cugcuggauucaagugau

SEQ ID NO: 43662 - RNA, 14 nt, Homo sapiens
cugcugguggcgcu

SEQ ID NO: 43663 - RNA, 15 nt, Homo sapiens
cugcugguggcgcug

SEQ ID NO: 43664 - RNA, 17 nt, Homo sapiens
cugcugguggcgcuggc

SEQ ID NO: 43665 - RNA, 21 nt, Homo sapiens
cugcugguggcgcuggcugcg

SEQ ID NO: 43666 - RNA, 22 nt, Homo sapiens
cugcugguggcgcuggcugcgc

SEQ ID NO: 43667 - RNA, 15 nt, Homo sapiens
cugcuuuaauuucau

SEQ ID NO: 43668 - RNA, 16 nt, Homo sapiens
cuggaaaccacauggc

SEQ ID NO: 43669 - RNA, 17 nt, Homo sapiens
cuggaaaccacauggcu

SEQ ID NO: 43670 - RNA, 21 nt, Homo sapiens
cuggaaaccacauggcuucac

SEQ ID NO: 43671 - RNA, 11 nt, Homo sapiens
cuggaaacuuc

SEQ ID NO: 43672 - RNA, 20 nt, Homo sapiens
cuggaagccucuauugccau

SEQ ID NO: 43673 - RNA, 11 nt, Homo sapiens
cuggacuuggc

SEQ ID NO: 43674 - RNA, 12 nt, Homo sapiens
cuggacuuggcc

SEQ ID NO: 43675 - RNA, 22 nt, Homo sapiens
cuggacuuuccagagaccagua

SEQ ID NO: 43676 - RNA, 13 nt, Homo sapiens
cuggagcucugcc

SEQ ID NO: 43677 - RNA, 22 nt, Homo sapiens
cuggagcuugaaauagugucug

SEQ ID NO: 43678 - RNA, 19 nt, Homo sapiens
cuggagugcaguggcgcaa

SEQ ID NO: 43679 - RNA, 20 nt, Homo sapiens
cuggauguggagggggcgcg

SEQ ID NO: 43680 - RNA, 21 nt, Homo sapiens
cuggauguggagggggcgcgu

SEQ ID NO: 43681 - RNA, 22 nt, Homo sapiens
cuggauguggagggggcgcgug

SEQ ID NO: 43682 - RNA, 22 nt, Homo sapiens
cuggauucaagugauccgccca

SEQ ID NO: 43683 - RNA, 15 nt, Homo sapiens
cuggauuugcaaccc

SEQ ID NO: 43684 - RNA, 16 nt, Homo sapiens
cuggauuugcaacccc

SEQ ID NO: 43685 - RNA, 20 nt, Homo sapiens
cuggauuugcaaccccauca

SEQ ID NO: 43686 - RNA, 12 nt, Homo sapiens
cuggcaccgcug

SEQ ID NO: 43687 - RNA, 13 nt, Homo sapiens
cuggccaggcugg

SEQ ID NO: 43688 - RNA, 17 nt, Homo sapiens
cuggccaggcuggucuc

SEQ ID NO: 43689 - RNA, 12 nt, Homo sapiens
cuggccugcugg

SEQ ID NO: 43690 - RNA, 16 nt, Homo sapiens
cuggccugcuggaugu

SEQ ID NO: 43691 - RNA, 22 nt, Homo sapiens
cuggcgacaguuuuccuucuca

SEQ ID NO: 43692 - RNA, 17 nt, Homo sapiens
cuggcguuguggggaug

SEQ ID NO: 43693 - RNA, 16 nt, Homo sapiens
cuggcuaugcauuuga

SEQ ID NO: 43694 - RNA, 13 nt, Homo sapiens
cuggcugcgcucg

SEQ ID NO: 43695 - RNA, 14 nt, Homo sapiens
cuggcugcgcucgg

SEQ ID NO: 43696 - RNA, 16 nt, Homo sapiens
cuggcugcgcucggcc

SEQ ID NO: 43697 - RNA, 17 nt, Homo sapiens
cuggcugcgcucggccu

SEQ ID NO: 43698 - RNA, 18 nt, Homo sapiens
cuggcugcgcucggccug

SEQ ID NO: 43699 - RNA, 19 nt, Homo sapiens
cuggcugcgcucggccugc

SEQ ID NO: 43700 - RNA, 20 nt, Homo sapiens
cuggcugcgcucggccugcu

SEQ ID NO: 43701 - RNA, 21 nt, Homo sapiens
cuggcugcgcucggccugcuc

SEQ ID NO: 43702 - RNA, 11 nt, Homo sapiens
cuggcugcugg

SEQ ID NO: 43703 - RNA, 15 nt, Homo sapiens
cuggcugcugguggc

SEQ ID NO: 43704 - RNA, 17 nt, Homo sapiens
cuggcugcugguggcgc

SEQ ID NO: 43705 - RNA, 19 nt, Homo sapiens
cuggcugcugguggcgcug

SEQ ID NO: 43706 - RNA, 21 nt, Homo sapiens
cuggcugcugguggcgcuggc

SEQ ID NO: 43707 - RNA, 22 nt, Homo sapiens
cuggcugcugguggcgcuggcu

SEQ ID NO: 43708 - RNA, 24 nt, Homo sapiens
cuggcugcugguggcgcuggcugc

SEQ ID NO: 43709 - RNA, 16 nt, Homo sapiens
cuggcugggaguggca

SEQ ID NO: 43710 - RNA, 16 nt, Homo sapiens
cuggcuggggccuguu

SEQ ID NO: 43711 - RNA, 18 nt, Homo sapiens
cuggcuggggccuguuga

SEQ ID NO: 43712 - RNA, 18 nt, Homo sapiens
cuggcuuaaaauguaauu

SEQ ID NO: 43713 - RNA, 21 nt, Homo sapiens
cugggaccaggcacccccaga

SEQ ID NO: 43714 - RNA, 18 nt, Homo sapiens
cugggcaagggaccugcu

SEQ ID NO: 43715 - RNA, 21 nt, Homo sapiens
cugggcaagggaccugcuucu

SEQ ID NO: 43716 - RNA, 16 nt, Homo sapiens
cugggccauagucauu

SEQ ID NO: 43717 - RNA, 17 nt, Homo sapiens
cugggcugaacacucca

SEQ ID NO: 43718 - RNA, 15 nt, Homo sapiens
cuggggccuguugaa

SEQ ID NO: 43719 - RNA, 18 nt, Homo sapiens
cugggguggguggggcag

SEQ ID NO: 43720 - RNA, 19 nt, Homo sapiens
cugggguggguggggcagu

SEQ ID NO: 43721 - RNA, 20 nt, Homo sapiens
cugggguggguggggcagug

SEQ ID NO: 43722 - RNA, 15 nt, Homo sapiens
cugggucgccggcau

SEQ ID NO: 43723 - RNA, 16 nt, Homo sapiens
cugggucgccggcauc

SEQ ID NO: 43724 - RNA, 14 nt, Homo sapiens
cuggguuccugcaa

SEQ ID NO: 43725 - RNA, 20 nt, Homo sapiens
cugguccuaagucccugcug

SEQ ID NO: 43726 - RNA, 22 nt, Homo sapiens
cugguccuaagucccugcugcc

SEQ ID NO: 43727 - RNA, 16 nt, Homo sapiens
cuggucuaccuguucg

SEQ ID NO: 43728 - RNA, 18 nt, Homo sapiens
cuggucuaccuguucgcg

SEQ ID NO: 43729 - RNA, 21 nt, Homo sapiens
cuggucuaccuguucgcgcgc

SEQ ID NO: 43730 - RNA, 14 nt, Homo sapiens
cuggucucgaacug

SEQ ID NO: 43731 - RNA, 15 nt, Homo sapiens
cuggucucgaacugc

SEQ ID NO: 43732 - RNA, 19 nt, Homo sapiens
cuggucucgaacugcugga

SEQ ID NO: 43733 - RNA, 20 nt, Homo sapiens
cuggucucgaacugcuggau

SEQ ID NO: 43734 - RNA, 17 nt, Homo sapiens
cuggugccucaccccuu

SEQ ID NO: 43735 - RNA, 13 nt, Homo sapiens
cugguggcgcugg

SEQ ID NO: 43736 - RNA, 15 nt, Homo sapiens
cugguggcgcuggcu

SEQ ID NO: 43737 - RNA, 20 nt, Homo sapiens
cugguggcgcuggcugcgcu

SEQ ID NO: 43738 - RNA, 21 nt, Homo sapiens
cugguggcgcuggcugcgcuc

SEQ ID NO: 43739 - RNA, 21 nt, Homo sapiens
cuguaaaauggagacaccacc

SEQ ID NO: 43740 - RNA, 23 nt, Homo sapiens
cuguaaaauggagacaccaccac

SEQ ID NO: 43741 - RNA, 14 nt, Homo sapiens
cuguaaucacagcu

SEQ ID NO: 43742 - RNA, 21 nt, Homo sapiens
cuguaaucacagcuacuuggg

SEQ ID NO: 43743 - RNA, 23 nt, Homo sapiens
cuguaaucccagcacuuugggag

SEQ ID NO: 43744 - RNA, 12 nt, Homo sapiens
cuguacgcgagc

SEQ ID NO: 43745 - RNA, 14 nt, Homo sapiens
cuguacgcgagcgc

SEQ ID NO: 43746 - RNA, 18 nt, Homo sapiens
cuguacgcgagcgcgcgc

SEQ ID NO: 43747 - RNA, 19 nt, Homo sapiens
cuguacgcgagcgcgcgcg

SEQ ID NO: 43748 - RNA, 21 nt, Homo sapiens
cuguacgcgagcgcgcgcgcc

SEQ ID NO: 43749 - RNA, 22 nt, Homo sapiens
cuguacgcgagcgcgcgcgccc

SEQ ID NO: 43750 - RNA, 22 nt, Homo sapiens
cuguacuccagccugggugaca

SEQ ID NO: 43751 - RNA, 14 nt, Homo sapiens
cuguaucaugacaa

SEQ ID NO: 43752 - RNA, 17 nt, Homo sapiens
cuguaugucucguggua

SEQ ID NO: 43753 - RNA, 20 nt, Homo sapiens
cuguauuuuaaaagaaugau

SEQ ID NO: 43754 - RNA, 21 nt, Homo sapiens
cuguauuuuaaaagaaugauu

SEQ ID NO: 43755 - RNA, 17 nt, Homo sapiens
cugucacggucacuuua

SEQ ID NO: 43756 - RNA, 18 nt, Homo sapiens
cugucacgugugggcaau

SEQ ID NO: 43757 - RNA, 15 nt, Homo sapiens
cugucccagcgaggg

SEQ ID NO: 43758 - RNA, 20 nt, Homo sapiens
cuguccccgaaacuaccagc

SEQ ID NO: 43759 - RNA, 21 nt, Homo sapiens
cuguccccgaaacuaccagcc

SEQ ID NO: 43760 - RNA, 22 nt, Homo sapiens
cuguccccgaaacuaccagccc

SEQ ID NO: 43761 - RNA, 19 nt, Homo sapiens
cugucccugcagacaugag

SEQ ID NO: 43762 - RNA, 20 nt, Homo sapiens
cugucccugcagacaugaga

SEQ ID NO: 43763 - RNA, 16 nt, Homo sapiens
cugucuggacuuucca

SEQ ID NO: 43764 - RNA, 20 nt, Homo sapiens
cugucuggacuuuccagaga

SEQ ID NO: 43765 - RNA, 15 nt, Homo sapiens
cugugaaauaguuca

SEQ ID NO: 43766 - RNA, 21 nt, Homo sapiens
cugugagaccaaauugagcua

SEQ ID NO: 43767 - RNA, 21 nt, Homo sapiens
cugugauucccuccugcuacu

SEQ ID NO: 43768 - RNA, 12 nt, Homo sapiens
cugugcggccug

SEQ ID NO: 43769 - RNA, 21 nt, Homo sapiens
cugugucucaggugugcccug

SEQ ID NO: 43770 - RNA, 17 nt, Homo sapiens
cuguguuagagcagaga

SEQ ID NO: 43771 - RNA, 15 nt, Homo sapiens
cuguuaaaagaugaa

SEQ ID NO: 43772 - RNA, 16 nt, Homo sapiens
cuguuaucuucacuuu

SEQ ID NO: 43773 - RNA, 18 nt, Homo sapiens
cuguuaucuucacuuuua

SEQ ID NO: 43774 - RNA, 19 nt, Homo sapiens
cuguuauuuuaucugcuau

SEQ ID NO: 43775 - RNA, 13 nt, Homo sapiens
cuguucacagcca

SEQ ID NO: 43776 - RNA, 13 nt, Homo sapiens
cuguuccucgcca

SEQ ID NO: 43777 - RNA, 18 nt, Homo sapiens
cuguuccuucacauccug

SEQ ID NO: 43778 - RNA, 14 nt, Homo sapiens
cuguucgcgcgccu

SEQ ID NO: 43779 - RNA, 18 nt, Homo sapiens
cuguucgcgcgccuccgc

SEQ ID NO: 43780 - RNA, 19 nt, Homo sapiens
cuguucgcgcgccuccgcu

SEQ ID NO: 43781 - RNA, 15 nt, Homo sapiens
cuguucuuuccaaag

SEQ ID NO: 43782 - RNA, 14 nt, Homo sapiens
cuguucuuucuggc

SEQ ID NO: 43783 - RNA, 19 nt, Homo sapiens
cuguuuagaugaaugucag

SEQ ID NO: 43784 - RNA, 17 nt, Homo sapiens
cuguuuuaugacuucau

SEQ ID NO: 43785 - RNA, 14 nt, Homo sapiens
cuuaaaaucuaauu

SEQ ID NO: 43786 - RNA, 13 nt, Homo sapiens
cuuaaaauguaau

SEQ ID NO: 43787 - RNA, 12 nt, Homo sapiens
cuuaaauaauaa

SEQ ID NO: 43788 - RNA, 22 nt, Homo sapiens
cuuaagacgugauuuugcugua

SEQ ID NO: 43789 - RNA, 24 nt, Homo sapiens
cuuaauuauugauguuuucauaga

SEQ ID NO: 43790 - RNA, 20 nt, Homo sapiens
cuuacguccuuccacuucca

SEQ ID NO: 43791 - RNA, 15 nt, Homo sapiens
cuuacuguacaugaa

SEQ ID NO: 43792 - RNA, 18 nt, Homo sapiens
cuuagacccucaugcugc

SEQ ID NO: 43793 - RNA, 21 nt, Homo sapiens
cuuagacccucaugcugccaa

SEQ ID NO: 43794 - RNA, 22 nt, Homo sapiens
cuuagacccucaugcugccaau

SEQ ID NO: 43795 - RNA, 17 nt, Homo sapiens
cuuagcccaucuuucaa

SEQ ID NO: 43796 - RNA, 18 nt, Homo sapiens
cuuaguaugugcauuuaa

SEQ ID NO: 43797 - RNA, 13 nt, Homo sapiens
cuuaguugcugua

SEQ ID NO: 43798 - RNA, 21 nt, Homo sapiens
cuuaguugcuguaugucucgu

SEQ ID NO: 43799 - RNA, 16 nt, Homo sapiens
cuuauaggaauugacc

SEQ ID NO: 43800 - RNA, 15 nt, Homo sapiens
cuuauccuccaugaa

SEQ ID NO: 43801 - RNA, 22 nt, Homo sapiens
cuuauccuccaugaauaucagu

SEQ ID NO: 43802 - RNA, 14 nt, Homo sapiens
cuuauugacuauua

SEQ ID NO: 43803 - RNA, 22 nt, Homo sapiens
cuuauugguggcuguuccugaa

SEQ ID NO: 43804 - RNA, 17 nt, Homo sapiens
cuucagcgguuuauaua

SEQ ID NO: 43805 - RNA, 19 nt, Homo sapiens
cuucaugcauuugcacuau

SEQ ID NO: 43806 - RNA, 21 nt, Homo sapiens
cuuccaaacagaacuauggaa

SEQ ID NO: 43807 - RNA, 16 nt, Homo sapiens
cuuccacuuccaagau

SEQ ID NO: 43808 - RNA, 16 nt, Homo sapiens
cuuccagggcuacgcg

SEQ ID NO: 43809 - RNA, 23 nt, Homo sapiens
cuuccagggcuacgcgcgcuccg

SEQ ID NO: 43810 - RNA, 17 nt, Homo sapiens
cuuccauuuggaaucau

SEQ ID NO: 43811 - RNA, 14 nt, Homo sapiens
cuucccacacuguc

SEQ ID NO: 43812 - RNA, 21 nt, Homo sapiens
cuucccacacuguccauucuu

SEQ ID NO: 43813 - RNA, 13 nt, Homo sapiens
cuucccgcuguuc

SEQ ID NO: 43814 - RNA, 19 nt, Homo sapiens
cuucccgcuguuccucgcc

SEQ ID NO: 43815 - RNA, 19 nt, Homo sapiens
cuucccuuuuacauacugc

SEQ ID NO: 43816 - RNA, 14 nt, Homo sapiens
cuuccucccauuca

SEQ ID NO: 43817 - RNA, 15 nt, Homo sapiens
cuuccucccauucag

SEQ ID NO: 43818 - RNA, 22 nt, Homo sapiens
cuuccucccggccgcgcugcgc

SEQ ID NO: 43819 - RNA, 17 nt, Homo sapiens
cuuccuggcaauaguca

SEQ ID NO: 43820 - RNA, 11 nt, Homo sapiens
cuuccuuauca

SEQ ID NO: 43821 - RNA, 15 nt, Homo sapiens
cuuccuuaucacuga

SEQ ID NO: 43822 - RNA, 16 nt, Homo sapiens
cuuccuuaucacugac

SEQ ID NO: 43823 - RNA, 21 nt, Homo sapiens
cuucgugaugacauaucacau

SEQ ID NO: 43824 - RNA, 13 nt, Homo sapiens
cuucuauuuauuu

SEQ ID NO: 43825 - RNA, 22 nt, Homo sapiens
cuucucagaaggcaaaugacuu

SEQ ID NO: 43826 - RNA, 19 nt, Homo sapiens
cuucucaucugugauuccc

SEQ ID NO: 43827 - RNA, 19 nt, Homo sapiens
cuucuccauggcccugcca

SEQ ID NO: 43828 - RNA, 18 nt, Homo sapiens
cuucucuucacagucaca

SEQ ID NO: 43829 - RNA, 17 nt, Homo sapiens
cuucugggcagacucug

SEQ ID NO: 43830 - RNA, 18 nt, Homo sapiens
cuucuggguucaagcgau

SEQ ID NO: 43831 - RNA, 19 nt, Homo sapiens
cuucuggguucaagcgauu

SEQ ID NO: 43832 - RNA, 21 nt, Homo sapiens
cuucuuggucucagugucaau

SEQ ID NO: 43833 - RNA, 14 nt, Homo sapiens
cuucuugguucuga

SEQ ID NO: 43834 - RNA, 17 nt, Homo sapiens
cuucuuucaugaagggg

SEQ ID NO: 43835 - RNA, 21 nt, Homo sapiens
cuucuuucaugaaggggcggc

SEQ ID NO: 43836 - RNA, 16 nt, Homo sapiens
cuugaaacugagaugu

SEQ ID NO: 43837 - RNA, 12 nt, Homo sapiens
cuugaacccagg

SEQ ID NO: 43838 - RNA, 14 nt, Homo sapiens
cuugagaagagaau

SEQ ID NO: 43839 - RNA, 15 nt, Homo sapiens
cuugagccuugaacu

SEQ ID NO: 43840 - RNA, 19 nt, Homo sapiens
cuugaugaagaaguugaua

SEQ ID NO: 43841 - RNA, 13 nt, Homo sapiens
cuugaugauacaa

SEQ ID NO: 43842 - RNA, 21 nt, Homo sapiens
cuugauugugggauacuauuu

SEQ ID NO: 43843 - RNA, 23 nt, Homo sapiens
cuugcaaaguaucccuacuguaa

SEQ ID NO: 43844 - RNA, 16 nt, Homo sapiens
cuugcuccuggcuggg

SEQ ID NO: 43845 - RNA, 17 nt, Homo sapiens
cuugcuccuggcugggg

SEQ ID NO: 43846 - RNA, 19 nt, Homo sapiens
cuuggacaugggccccaga

SEQ ID NO: 43847 - RNA, 20 nt, Homo sapiens
cuuggcccaggaguuuggcc

SEQ ID NO: 43848 - RNA, 21 nt, Homo sapiens
cuuggcccaggaguuuggcca

SEQ ID NO: 43849 - RNA, 22 nt, Homo sapiens
cuuggcccaggaguuuggccag

SEQ ID NO: 43850 - RNA, 23 nt, Homo sapiens
cuuggcccaggaguuuggccaga

SEQ ID NO: 43851 - RNA, 14 nt, Homo sapiens
cuuggccccugcca

SEQ ID NO: 43852 - RNA, 15 nt, Homo sapiens
cuugguauagcauau

SEQ ID NO: 43853 - RNA, 18 nt, Homo sapiens
cuuggucacauacaauua

SEQ ID NO: 43854 - RNA, 12 nt, Homo sapiens
cuuggucucagu

SEQ ID NO: 43855 - RNA, 21 nt, Homo sapiens
cuuguagcucucugaccuccu

SEQ ID NO: 43856 - RNA, 22 nt, Homo sapiens
cuuguagcucucugaccuccuc

SEQ ID NO: 43857 - RNA, 15 nt, Homo sapiens
cuugugaacccaaag

SEQ ID NO: 43858 - RNA, 20 nt, Homo sapiens
cuuguuaaguaucagcuaca

SEQ ID NO: 43859 - RNA, 17 nt, Homo sapiens
cuuguuagcaaaaugga

SEQ ID NO: 43860 - RNA, 23 nt, Homo sapiens
cuuguuuuuccacuacugcuacc

SEQ ID NO: 43861 - RNA, 23 nt, Homo sapiens
cuuuaaaaaaaaaaaaaaagcca

SEQ ID NO: 43862 - RNA, 17 nt, Homo sapiens
cuuuaaaacuuauccuc

SEQ ID NO: 43863 - RNA, 19 nt, Homo sapiens
cuuuaaaacuuauccucca

SEQ ID NO: 43864 - RNA, 20 nt, Homo sapiens
cuuuaaagggauggcaagau

SEQ ID NO: 43865 - RNA, 18 nt, Homo sapiens
cuuuaacacagugucugg

SEQ ID NO: 43866 - RNA, 15 nt, Homo sapiens
cuuuaagaacuaaaa

SEQ ID NO: 43867 - RNA, 19 nt, Homo sapiens
cuuuaaguguaacuggcag

SEQ ID NO: 43868 - RNA, 20 nt, Homo sapiens
cuuuacuguccccaucauca

SEQ ID NO: 43869 - RNA, 13 nt, Homo sapiens
cuuuaucucaggg

SEQ ID NO: 43870 - RNA, 19 nt, Homo sapiens
cuuucaagggaccucucca

SEQ ID NO: 43871 - RNA, 22 nt, Homo sapiens
cuuucaagggaccucuccauga

SEQ ID NO: 43872 - RNA, 22 nt, Homo sapiens
cuuucacauuggcuauuuaaag

SEQ ID NO: 43873 - RNA, 19 nt, Homo sapiens
cuuucagauaacuguuauu

SEQ ID NO: 43874 - RNA, 20 nt, Homo sapiens
cuuucagcucagcuaaugaa

SEQ ID NO: 43875 - RNA, 21 nt, Homo sapiens
cuuucaugaaggggcggcggc

SEQ ID NO: 43876 - RNA, 13 nt, Homo sapiens
cuuugaagucuga

SEQ ID NO: 43877 - RNA, 15 nt, Homo sapiens
cuuugaagucugauu

SEQ ID NO: 43878 - RNA, 17 nt, Homo sapiens
cuuugaccucugcagca

SEQ ID NO: 43879 - RNA, 18 nt, Homo sapiens
cuuugaccucugcagcaa

SEQ ID NO: 43880 - RNA, 21 nt, Homo sapiens
cuuugcuuuaaguguaacugg

SEQ ID NO: 43881 - RNA, 21 nt, Homo sapiens
cuuugggaggcugaggcgggu

SEQ ID NO: 43882 - RNA, 22 nt, Homo sapiens
cuuugggaggcugaggcgggug

SEQ ID NO: 43883 - RNA, 23 nt, Homo sapiens
cuuugggaggcugaggcgggugg

SEQ ID NO: 43884 - RNA, 22 nt, Homo sapiens
cuuugugcagauucuuuacccc

SEQ ID NO: 43885 - RNA, 23 nt, Homo sapiens
cuuugugcagauucuuuaccccc

SEQ ID NO: 43886 - RNA, 22 nt, Homo sapiens
cuuuguugcuaucaauccaaga

SEQ ID NO: 43887 - RNA, 14 nt, Homo sapiens
cuuuucaacacaca

SEQ ID NO: 43888 - RNA, 19 nt, Homo sapiens
cuuuucaacacacaaagca

SEQ ID NO: 43889 - RNA, 11 nt, Homo sapiens
cuuuucucugc

SEQ ID NO: 43890 - RNA, 14 nt, Homo sapiens
cuuuucuuuucuuu

SEQ ID NO: 43891 - RNA, 11 nt, Homo sapiens
cuuuugugcau

SEQ ID NO: 43892 - RNA, 13 nt, Homo sapiens
cuuuugugcauua

SEQ ID NO: 43893 - RNA, 18 nt, Homo sapiens
cuuuuuccagguuccuga

SEQ ID NO: 43894 - RNA, 13 nt, Homo sapiens
gaaaaacauuuca

SEQ ID NO: 43895 - RNA, 18 nt, Homo sapiens
gaaaagauuaugaucuca

SEQ ID NO: 43896 - RNA, 17 nt, Homo sapiens
gaaaagggaacugaaca

SEQ ID NO: 43897 - RNA, 17 nt, Homo sapiens
gaaaaggugucuugcug

SEQ ID NO: 43898 - RNA, 15 nt, Homo sapiens
gaaaaguuucccagu

SEQ ID NO: 43899 - RNA, 16 nt, Homo sapiens
gaaaauaaaagcacuu

SEQ ID NO: 43900 - RNA, 17 nt, Homo sapiens
gaaaauaaaauauuuaa

SEQ ID NO: 43901 - RNA, 19 nt, Homo sapiens
gaaaauaguggugugauuu

SEQ ID NO: 43902 - RNA, 12 nt, Homo sapiens
gaaaauaugccu

SEQ ID NO: 43903 - RNA, 19 nt, Homo sapiens
gaaaaucugcacugugggc

SEQ ID NO: 43904 - RNA, 18 nt, Homo sapiens
gaaaaugguauuaaagau

SEQ ID NO: 43905 - RNA, 13 nt, Homo sapiens
gaaaaugugcaau

SEQ ID NO: 43906 - RNA, 14 nt, Homo sapiens
gaaaaugugcaaua

SEQ ID NO: 43907 - RNA, 15 nt, Homo sapiens
gaaaccagggagccc

SEQ ID NO: 43908 - RNA, 17 nt, Homo sapiens
gaaaccuuauuguaccu

SEQ ID NO: 43909 - RNA, 21 nt, Homo sapiens
gaaacuccacauccuguggga

SEQ ID NO: 43910 - RNA, 19 nt, Homo sapiens
gaaacugccagcaacgcag

SEQ ID NO: 43911 - RNA, 14 nt, Homo sapiens
gaaagaagagccgg

SEQ ID NO: 43912 - RNA, 19 nt, Homo sapiens
gaaagaagagccggagccu

SEQ ID NO: 43913 - RNA, 18 nt, Homo sapiens
gaaagacuauucaaacag

SEQ ID NO: 43914 - RNA, 13 nt, Homo sapiens
gaaagcagggacu

SEQ ID NO: 43915 - RNA, 17 nt, Homo sapiens
gaaagcugaguguuuca

SEQ ID NO: 43916 - RNA, 22 nt, Homo sapiens
gaaagcuguggccagcuuguua

SEQ ID NO: 43917 - RNA, 23 nt, Homo sapiens
gaaagcuugcccuggugccucac

SEQ ID NO: 43918 - RNA, 13 nt, Homo sapiens
gaaagguacuuca

SEQ ID NO: 43919 - RNA, 14 nt, Homo sapiens
gaaagucccagauc

SEQ ID NO: 43920 - RNA, 15 nt, Homo sapiens
gaaauaaaccuauga

SEQ ID NO: 43921 - RNA, 16 nt, Homo sapiens
gaaauaaaccuaugaa

SEQ ID NO: 43922 - RNA, 17 nt, Homo sapiens
gaaauaaaccuaugaau

SEQ ID NO: 43923 - RNA, 23 nt, Homo sapiens
gaaauacacuguuaucuucacuu

SEQ ID NO: 43924 - RNA, 13 nt, Homo sapiens
gaaauaggaaaua

SEQ ID NO: 43925 - RNA, 18 nt, Homo sapiens
gaaauaggaaauauuuua

SEQ ID NO: 43926 - RNA, 17 nt, Homo sapiens
gaaauagugucugauga

SEQ ID NO: 43927 - RNA, 14 nt, Homo sapiens
gaaauauuccuuaa

SEQ ID NO: 43928 - RNA, 22 nt, Homo sapiens
gaaauauuccuuaagauauuaa

SEQ ID NO: 43929 - RNA, 17 nt, Homo sapiens
gaaauauuuauuuuaau

SEQ ID NO: 43930 - RNA, 14 nt, Homo sapiens
gaaauauuuuaaug

SEQ ID NO: 43931 - RNA, 21 nt, Homo sapiens
gaaaugacuaaaaaacaaaga

SEQ ID NO: 43932 - RNA, 23 nt, Homo sapiens
gaaauuugccaauuuacuuuguu

SEQ ID NO: 43933 - RNA, 13 nt, Homo sapiens
gaacacaucagcu

SEQ ID NO: 43934 - RNA, 14 nt, Homo sapiens
gaacacaucagcuu

SEQ ID NO: 43935 - RNA, 14 nt, Homo sapiens
gaacagaagaggaa

SEQ ID NO: 43936 - RNA, 11 nt, Homo sapiens
gaacauaaaau

SEQ ID NO: 43937 - RNA, 12 nt, Homo sapiens
gaaccaccugcc

SEQ ID NO: 43938 - RNA, 21 nt, Homo sapiens
gaaccacucuaucaaguauua

SEQ ID NO: 43939 - RNA, 16 nt, Homo sapiens
gaacccgggaggcaga

SEQ ID NO: 43940 - RNA, 20 nt, Homo sapiens
gaaccguuugugauugccau

SEQ ID NO: 43941 - RNA, 21 nt, Homo sapiens
gaaccguuugugauugccauu

SEQ ID NO: 43942 - RNA, 14 nt, Homo sapiens
gaacuaaaauguuc

SEQ ID NO: 43943 - RNA, 21 nt, Homo sapiens
gaacucaaggaaaucuguguc

SEQ ID NO: 43944 - RNA, 15 nt, Homo sapiens
gaacugaacauucca

SEQ ID NO: 43945 - RNA, 17 nt, Homo sapiens
gaacugcauauguuucg

SEQ ID NO: 43946 - RNA, 12 nt, Homo sapiens
gaacugcuggau

SEQ ID NO: 43947 - RNA, 20 nt, Homo sapiens
gaacugcuggauucaaguga

SEQ ID NO: 43948 - RNA, 23 nt, Homo sapiens
gaacuuauuuguacauuuuuuuu

SEQ ID NO: 43949 - RNA, 18 nt, Homo sapiens
gaacuuuuuguuuuguuu

SEQ ID NO: 43950 - RNA, 23 nt, Homo sapiens
gaagaaaauaguggugugauuug

SEQ ID NO: 43951 - RNA, 14 nt, Homo sapiens
gaagaaauuccagg

SEQ ID NO: 43952 - RNA, 14 nt, Homo sapiens
gaagaaauucugca

SEQ ID NO: 43953 - RNA, 18 nt, Homo sapiens
gaagaagcaccaaucaug

SEQ ID NO: 43954 - RNA, 11 nt, Homo sapiens
gaagaaugacu

SEQ ID NO: 43955 - RNA, 17 nt, Homo sapiens
gaagacaaugacuuacu

SEQ ID NO: 43956 - RNA, 23 nt, Homo sapiens
gaagagaauauuagcuuuacugu

SEQ ID NO: 43957 - RNA, 15 nt, Homo sapiens
gaagagccggagccu

SEQ ID NO: 43958 - RNA, 20 nt, Homo sapiens
gaagagccggagccuccagc

SEQ ID NO: 43959 - RNA, 22 nt, Homo sapiens
gaagagguuuuaaagcuuccau

SEQ ID NO: 43960 - RNA, 19 nt, Homo sapiens
gaagaguggguuucacaag

SEQ ID NO: 43961 - RNA, 22 nt, Homo sapiens
gaagaguggguuucacaaguga

SEQ ID NO: 43962 - RNA, 13 nt, Homo sapiens
gaagauacugaaa

SEQ ID NO: 43963 - RNA, 15 nt, Homo sapiens
gaagauucuauguua

SEQ ID NO: 43964 - RNA, 23 nt, Homo sapiens
gaagauucuauguuaauauuuua

SEQ ID NO: 43965 - RNA, 14 nt, Homo sapiens
gaagcacagugauc

SEQ ID NO: 43966 - RNA, 13 nt, Homo sapiens
gaagcaucacagg

SEQ ID NO: 43967 - RNA, 13 nt, Homo sapiens
gaagcaucguguc

SEQ ID NO: 43968 - RNA, 16 nt, Homo sapiens
gaagccucuauugcca

SEQ ID NO: 43969 - RNA, 17 nt, Homo sapiens
gaagccucuauugccau

SEQ ID NO: 43970 - RNA, 19 nt, Homo sapiens
gaagccucuauugccauga

SEQ ID NO: 43971 - RNA, 12 nt, Homo sapiens
gaaggauacaaa

SEQ ID NO: 43972 - RNA, 9 nt, Homo sapiens
gaaggggcg

SEQ ID NO: 43973 - RNA, 15 nt, Homo sapiens
gaaggggcggcggcc

SEQ ID NO: 43974 - RNA, 17 nt, Homo sapiens
gaaggggcggcggcccu

SEQ ID NO: 43975 - RNA, 15 nt, Homo sapiens
gaaguaaauguuguu

SEQ ID NO: 43976 - RNA, 22 nt, Homo sapiens
gaaguacucauacauguuacaa

SEQ ID NO: 43977 - RNA, 20 nt, Homo sapiens
gaaguauccuucagccugaa

SEQ ID NO: 43978 - RNA, 12 nt, Homo sapiens
gaagucaaggcu

SEQ ID NO: 43979 - RNA, 15 nt, Homo sapiens
gaagucaaggcuuag

SEQ ID NO: 43980 - RNA, 15 nt, Homo sapiens
gaagucuucuauuua

SEQ ID NO: 43981 - RNA, 16 nt, Homo sapiens
gaaguuuaauugacuu

SEQ ID NO: 43982 - RNA, 18 nt, Homo sapiens
gaauaaauaaauguaucu

SEQ ID NO: 43983 - RNA, 17 nt, Homo sapiens
gaauacauaaaguaugu

SEQ ID NO: 43984 - RNA, 17 nt, Homo sapiens
gaauacauucugcuuuc

SEQ ID NO: 43985 - RNA, 15 nt, Homo sapiens
gaauacuaauaaaau

SEQ ID NO: 43986 - RNA, 19 nt, Homo sapiens
gaauacuaauaaaauacau

SEQ ID NO: 43987 - RNA, 22 nt, Homo sapiens
gaauaguguuggaaaaugugca

SEQ ID NO: 43988 - RNA, 14 nt, Homo sapiens
gaauaucaguuauu

SEQ ID NO: 43989 - RNA, 17 nt, Homo sapiens
gaaucacuggcuguuaa

SEQ ID NO: 43990 - RNA, 17 nt, Homo sapiens
gaaucacuugaacccgg

SEQ ID NO: 43991 - RNA, 16 nt, Homo sapiens
gaaucccuuaaacuca

SEQ ID NO: 43992 - RNA, 14 nt, Homo sapiens
gaaugaccuggccg

SEQ ID NO: 43993 - RNA, 14 nt, Homo sapiens
gaaugagaagaaug

SEQ ID NO: 43994 - RNA, 17 nt, Homo sapiens
gaaugagaagaaugacu

SEQ ID NO: 43995 - RNA, 15 nt, Homo sapiens
gaauguaugugcaca

SEQ ID NO: 43996 - RNA, 15 nt, Homo sapiens
gaauuaacacaugau

SEQ ID NO: 43997 - RNA, 16 nt, Homo sapiens
gaauuaacacaugauc

SEQ ID NO: 43998 - RNA, 13 nt, Homo sapiens
gaauuaauggaau

SEQ ID NO: 43999 - RNA, 21 nt, Homo sapiens
gaauuacaggcgugagccacc

SEQ ID NO: 44000 - RNA, 22 nt, Homo sapiens
gaauuacaggcgugagccacca

SEQ ID NO: 44001 - RNA, 23 nt, Homo sapiens
gaauuacaggcgugagccaccaa

SEQ ID NO: 44002 - RNA, 17 nt, Homo sapiens
gaauucacuccacuugg

SEQ ID NO: 44003 - RNA, 23 nt, Homo sapiens
gaauucuuacauguuuucuuugc

SEQ ID NO: 44004 - RNA, 11 nt, Homo sapiens
gaauugaccca

SEQ ID NO: 44005 - RNA, 16 nt, Homo sapiens
gaauugacccacaaga

SEQ ID NO: 44006 - RNA, 18 nt, Homo sapiens
gaauugcuugaacccagg

SEQ ID NO: 44007 - RNA, 15 nt, Homo sapiens
gaauuggagcucgug

SEQ ID NO: 44008 - RNA, 16 nt, Homo sapiens
gaauuggagcucgugg

SEQ ID NO: 44009 - RNA, 20 nt, Homo sapiens
gaauuguuuuuauggaggcu

SEQ ID NO: 44010 - RNA, 12 nt, Homo sapiens
gaauuuccuuac

SEQ ID NO: 44011 - RNA, 14 nt, Homo sapiens
gaauuuucuuccaa

SEQ ID NO: 44012 - RNA, 16 nt, Homo sapiens
gacaaagacaaauucu

SEQ ID NO: 44013 - RNA, 18 nt, Homo sapiens
gacaaagacaaauucugu

SEQ ID NO: 44014 - RNA, 16 nt, Homo sapiens
gacaaaugacccccau

SEQ ID NO: 44015 - RNA, 16 nt, Homo sapiens
gacaacauuaaaacaa

SEQ ID NO: 44016 - RNA, 15 nt, Homo sapiens
gacaacugugacugu

SEQ ID NO: 44017 - RNA, 17 nt, Homo sapiens
gacaagcucacagaccu

SEQ ID NO: 44018 - RNA, 18 nt, Homo sapiens
gacaagcucacagaccuu

SEQ ID NO: 44019 - RNA, 14 nt, Homo sapiens
gacacacugaagaa

SEQ ID NO: 44020 - RNA, 15 nt, Homo sapiens
gacacacugaagaag

SEQ ID NO: 44021 - RNA, 13 nt, Homo sapiens
gacacagcugcag

SEQ ID NO: 44022 - RNA, 22 nt, Homo sapiens
gacacaggcuccaaacuggagc

SEQ ID NO: 44023 - RNA, 23 nt, Homo sapiens
gacacaggcuccaaacuggagcu

SEQ ID NO: 44024 - RNA, 17 nt, Homo sapiens
gacacaugcaaggucau

SEQ ID NO: 44025 - RNA, 17 nt, Homo sapiens
gacacaugggugcuauu

SEQ ID NO: 44026 - RNA, 20 nt, Homo sapiens
gacaccaccacccuugccau

SEQ ID NO: 44027 - RNA, 21 nt, Homo sapiens
gacaccaccacccuugccaug

SEQ ID NO: 44028 - RNA, 22 nt, Homo sapiens
gacaccaccacccuugccaugg

SEQ ID NO: 44029 - RNA, 13 nt, Homo sapiens
gacaccgaguggc

SEQ ID NO: 44030 - RNA, 17 nt, Homo sapiens
gacacuaaaacaccuca

SEQ ID NO: 44031 - RNA, 13 nt, Homo sapiens
gacagaaagcaga

SEQ ID NO: 44032 - RNA, 20 nt, Homo sapiens
gacaggaggggaaggcaaca

SEQ ID NO: 44033 - RNA, 18 nt, Homo sapiens
gacaggauaagagggauu

SEQ ID NO: 44034 - RNA, 20 nt, Homo sapiens
gacaggauaagagggauuag

SEQ ID NO: 44035 - RNA, 21 nt, Homo sapiens
gacaggauaagagggauuagg

SEQ ID NO: 44036 - RNA, 15 nt, Homo sapiens
gacaguuuucugcuu

SEQ ID NO: 44037 - RNA, 19 nt, Homo sapiens
gacauaagcaaagacuaug

SEQ ID NO: 44038 - RNA, 19 nt, Homo sapiens
gacaugagagacagcaggu

SEQ ID NO: 44039 - RNA, 22 nt, Homo sapiens
gacaugagagacagcaggucuc

SEQ ID NO: 44040 - RNA, 16 nt, Homo sapiens
gacaugggacauuugc

SEQ ID NO: 44041 - RNA, 20 nt, Homo sapiens
gacaugggccccagauacca

SEQ ID NO: 44042 - RNA, 19 nt, Homo sapiens
gacauguuuacaaaccuca

SEQ ID NO: 44043 - RNA, 17 nt, Homo sapiens
gaccaaggcccccgggc

SEQ ID NO: 44044 - RNA, 18 nt, Homo sapiens
gaccaaggcccccgggcc

SEQ ID NO: 44045 - RNA, 21 nt, Homo sapiens
gaccaaggcccccgggccgac

SEQ ID NO: 44046 - RNA, 24 nt, Homo sapiens
gaccaaggcccccgggccgacgga

SEQ ID NO: 44047 - RNA, 22 nt, Homo sapiens
gaccaauaaccaugcccaagaa

SEQ ID NO: 44048 - RNA, 21 nt, Homo sapiens
gaccacgcuuucuagcuguug

SEQ ID NO: 44049 - RNA, 14 nt, Homo sapiens
gaccacguuucuaa

SEQ ID NO: 44050 - RNA, 16 nt, Homo sapiens
gaccagccaaccuggg

SEQ ID NO: 44051 - RNA, 17 nt, Homo sapiens
gaccaggcacccccaga

SEQ ID NO: 44052 - RNA, 22 nt, Homo sapiens
gaccauaaccccggaagccaaa

SEQ ID NO: 44053 - RNA, 13 nt, Homo sapiens
gaccaucccggcc

SEQ ID NO: 44054 - RNA, 19 nt, Homo sapiens
gaccaucccggccggcgcg

SEQ ID NO: 44055 - RNA, 21 nt, Homo sapiens
gaccaucccggccggcgcgcu

SEQ ID NO: 44056 - RNA, 22 nt, Homo sapiens
gaccaucccggccggcgcgcuc

SEQ ID NO: 44057 - RNA, 14 nt, Homo sapiens
gacccucaugcugc

SEQ ID NO: 44058 - RNA, 15 nt, Homo sapiens
gacccucaugcugcc

SEQ ID NO: 44059 - RNA, 14 nt, Homo sapiens
gaccuccuccuuca

SEQ ID NO: 44060 - RNA, 15 nt, Homo sapiens
gaccuccuccuucau

SEQ ID NO: 44061 - RNA, 11 nt, Homo sapiens
gaccugcuguu

SEQ ID NO: 44062 - RNA, 12 nt, Homo sapiens
gaccugcuucua

SEQ ID NO: 44063 - RNA, 14 nt, Homo sapiens
gaccuucccagcua

SEQ ID NO: 44064 - RNA, 22 nt, Homo sapiens
gaccuuuguagccacuucacuu

SEQ ID NO: 44065 - RNA, 13 nt, Homo sapiens
gacgaaccuugaa

SEQ ID NO: 44066 - RNA, 13 nt, Homo sapiens
gacgcugcugccg

SEQ ID NO: 44067 - RNA, 14 nt, Homo sapiens
gacgcugcugccgu

SEQ ID NO: 44068 - RNA, 15 nt, Homo sapiens
gacgcugcugccgug

SEQ ID NO: 44069 - RNA, 17 nt, Homo sapiens
gacgcugcugccguggg

SEQ ID NO: 44070 - RNA, 13 nt, Homo sapiens
gacggagccggga

SEQ ID NO: 44071 - RNA, 14 nt, Homo sapiens
gacggagccgggaa

SEQ ID NO: 44072 - RNA, 11 nt, Homo sapiens
gacggcuccgg

SEQ ID NO: 44073 - RNA, 14 nt, Homo sapiens
gacggcuccggacg

SEQ ID NO: 44074 - RNA, 15 nt, Homo sapiens
gacggcuccggacgc

SEQ ID NO: 44075 - RNA, 20 nt, Homo sapiens
gacggcuccggacgcugcug

SEQ ID NO: 44076 - RNA, 21 nt, Homo sapiens
gacgggguuugccaugcuggc

SEQ ID NO: 44077 - RNA, 13 nt, Homo sapiens
gacgugacuggcc

SEQ ID NO: 44078 - RNA, 18 nt, Homo sapiens
gacgugauuuugcuguag

SEQ ID NO: 44079 - RNA, 19 nt, Homo sapiens
gacgugauuuugcuguaga

SEQ ID NO: 44080 - RNA, 12 nt, Homo sapiens
gacuaaaaaaca

SEQ ID NO: 44081 - RNA, 14 nt, Homo sapiens
gacuaaaaaacaaa

SEQ ID NO: 44082 - RNA, 15 nt, Homo sapiens
gacuaauuaggcaag

SEQ ID NO: 44083 - RNA, 20 nt, Homo sapiens
gacuauuauagaauggaacu

SEQ ID NO: 44084 - RNA, 21 nt, Homo sapiens
gacucauuuuaaaaaauggaa

SEQ ID NO: 44085 - RNA, 18 nt, Homo sapiens
gacucuggucaagaagca

SEQ ID NO: 44086 - RNA, 12 nt, Homo sapiens
gacucuuaagaa

SEQ ID NO: 44087 - RNA, 22 nt, Homo sapiens
gacugaguacguugugcauuug

SEQ ID NO: 44088 - RNA, 21 nt, Homo sapiens
gacugcuaguuuauauagaaa

SEQ ID NO: 44089 - RNA, 13 nt, Homo sapiens
gacuggccugcug

SEQ ID NO: 44090 - RNA, 14 nt, Homo sapiens
gacuggccugcugg

SEQ ID NO: 44091 - RNA, 15 nt, Homo sapiens
gacuggccugcugga

SEQ ID NO: 44092 - RNA, 16 nt, Homo sapiens
gacuguacccaaaugg

SEQ ID NO: 44093 - RNA, 17 nt, Homo sapiens
gacuguacccaaaugga

SEQ ID NO: 44094 - RNA, 15 nt, Homo sapiens
gacuuaaaaucuaau

SEQ ID NO: 44095 - RNA, 17 nt, Homo sapiens
gacuucugucuucacaa

SEQ ID NO: 44096 - RNA, 17 nt, Homo sapiens
gacuuggccccugccac

SEQ ID NO: 44097 - RNA, 18 nt, Homo sapiens
gacuuggccccugccacc

SEQ ID NO: 44098 - RNA, 13 nt, Homo sapiens
gacuugggcggga

SEQ ID NO: 44099 - RNA, 14 nt, Homo sapiens
gacuugggcgggac

SEQ ID NO: 44100 - RNA, 16 nt, Homo sapiens
gacuuguacucugaaa

SEQ ID NO: 44101 - RNA, 17 nt, Homo sapiens
gacuuguacucugaaag

SEQ ID NO: 44102 - RNA, 16 nt, Homo sapiens
gacuuuggcaaaugag

SEQ ID NO: 44103 - RNA, 11 nt, Homo sapiens
gacuuuuuaug

SEQ ID NO: 44104 - RNA, 16 nt, Homo sapiens
gagaaaauaaaagcac

SEQ ID NO: 44105 - RNA, 23 nt, Homo sapiens
gagaaaccagggagccccuuuga

SEQ ID NO: 44106 - RNA, 20 nt, Homo sapiens
gagaaaccuuauuguaccuc

SEQ ID NO: 44107 - RNA, 19 nt, Homo sapiens
gagaacugcauauguuucg

SEQ ID NO: 44108 - RNA, 18 nt, Homo sapiens
gagaagaaugacuaugca

SEQ ID NO: 44109 - RNA, 22 nt, Homo sapiens
gagaagagcuguucacagccag

SEQ ID NO: 44110 - RNA, 21 nt, Homo sapiens
gagaaggcuguggauuuaaug

SEQ ID NO: 44111 - RNA, 15 nt, Homo sapiens
gagaauaaaaaaugu

SEQ ID NO: 44112 - RNA, 18 nt, Homo sapiens
gagaaucagaucauuuca

SEQ ID NO: 44113 - RNA, 20 nt, Homo sapiens
gagaauuuccuuacucuuga

SEQ ID NO: 44114 - RNA, 15 nt, Homo sapiens
gagacacacugaaga

SEQ ID NO: 44115 - RNA, 13 nt, Homo sapiens
gagacacaugggu

SEQ ID NO: 44116 - RNA, 15 nt, Homo sapiens
gagacaccaccaccc

SEQ ID NO: 44117 - RNA, 22 nt, Homo sapiens
gagacaccaccacccuugccau

SEQ ID NO: 44118 - RNA, 14 nt, Homo sapiens
gagacagaaagcag

SEQ ID NO: 44119 - RNA, 14 nt, Homo sapiens
gagacagcaggucu

SEQ ID NO: 44120 - RNA, 15 nt, Homo sapiens
gagacagcaggucuc

SEQ ID NO: 44121 - RNA, 19 nt, Homo sapiens
gagaccaaggcccccgggc

SEQ ID NO: 44122 - RNA, 13 nt, Homo sapiens
gagaccagccaac

SEQ ID NO: 44123 - RNA, 16 nt, Homo sapiens
gagaccagccaaccug

SEQ ID NO: 44124 - RNA, 18 nt, Homo sapiens
gagaccagccaaccuggg

SEQ ID NO: 44125 - RNA, 17 nt, Homo sapiens
gagacgggguuugccau

SEQ ID NO: 44126 - RNA, 19 nt, Homo sapiens
gagacgggguuugccaugc

SEQ ID NO: 44127 - RNA, 20 nt, Homo sapiens
gagacgggguuugccaugcu

SEQ ID NO: 44128 - RNA, 22 nt, Homo sapiens
gagacgggguuugccaugcugg

SEQ ID NO: 44129 - RNA, 17 nt, Homo sapiens
gagacucugucucaguc

SEQ ID NO: 44130 - RNA, 13 nt, Homo sapiens
gagagaaugagag

SEQ ID NO: 44131 - RNA, 17 nt, Homo sapiens
gagagacacacugaaga

SEQ ID NO: 44132 - RNA, 18 nt, Homo sapiens
gagagacacacugaagaa

SEQ ID NO: 44133 - RNA, 20 nt, Homo sapiens
gagauggaaguugcagugag

SEQ ID NO: 44134 - RNA, 21 nt, Homo sapiens
gagaugggagaaucacuugaa

SEQ ID NO: 44135 - RNA, 21 nt, Homo sapiens
gagauugugccccugcacucc

SEQ ID NO: 44136 - RNA, 10 nt, Homo sapiens
gagcaaaagu

SEQ ID NO: 44137 - RNA, 12 nt, Homo sapiens
gagcaccugcag

SEQ ID NO: 44138 - RNA, 16 nt, Homo sapiens
gagcaccugcaggcgu

SEQ ID NO: 44139 - RNA, 19 nt, Homo sapiens
gagcaccugcaggcgugac

SEQ ID NO: 44140 - RNA, 23 nt, Homo sapiens
gagcaccugcaggcgugaccuga

SEQ ID NO: 44141 - RNA, 16 nt, Homo sapiens
gagcaggcuacuguca

SEQ ID NO: 44142 - RNA, 15 nt, Homo sapiens
gagcaguagcagcag

SEQ ID NO: 44143 - RNA, 17 nt, Homo sapiens
gagcaguagcagcagca

SEQ ID NO: 44144 - RNA, 14 nt, Homo sapiens
gagcagucagaaga

SEQ ID NO: 44145 - RNA, 12 nt, Homo sapiens
gagcagucagga

SEQ ID NO: 44146 - RNA, 23 nt, Homo sapiens
gagcaucacaguuuugguugcuu

SEQ ID NO: 44147 - RNA, 19 nt, Homo sapiens
gagccaccaaacccggccu

SEQ ID NO: 44148 - RNA, 21 nt, Homo sapiens
gagccaccaaacccggccuga

SEQ ID NO: 44149 - RNA, 12 nt, Homo sapiens
gagccccaaaag

SEQ ID NO: 44150 - RNA, 18 nt, Homo sapiens
gagccccuugggcagguc

SEQ ID NO: 44151 - RNA, 11 nt, Homo sapiens
gagccggagcc

SEQ ID NO: 44152 - RNA, 14 nt, Homo sapiens
gagccggagccucc

SEQ ID NO: 44153 - RNA, 15 nt, Homo sapiens
gagccggagccucca

SEQ ID NO: 44154 - RNA, 21 nt, Homo sapiens
gagccggagccuccagcugcc

SEQ ID NO: 44155 - RNA, 22 nt, Homo sapiens
gagccggagccuccagcugccc

SEQ ID NO: 44156 - RNA, 13 nt, Homo sapiens
gagccgggaaaga

SEQ ID NO: 44157 - RNA, 21 nt, Homo sapiens
gagccgggaaagaagagccgg

SEQ ID NO: 44158 - RNA, 23 nt, Homo sapiens
gagccgggaaagaagagccggag

SEQ ID NO: 44159 - RNA, 21 nt, Homo sapiens
gagccgguccuugcugcaccu

SEQ ID NO: 44160 - RNA, 13 nt, Homo sapiens
gagccuccagcug

SEQ ID NO: 44161 - RNA, 16 nt, Homo sapiens
gagccuccagcugccc

SEQ ID NO: 44162 - RNA, 18 nt, Homo sapiens
gagccuccagcugccccg

SEQ ID NO: 44163 - RNA, 22 nt, Homo sapiens
gagccuccagcugccccgggga

SEQ ID NO: 44164 - RNA, 16 nt, Homo sapiens
gagcgagccccaggcg

SEQ ID NO: 44165 - RNA, 12 nt, Homo sapiens
gagcgcgcgcgc

SEQ ID NO: 44166 - RNA, 13 nt, Homo sapiens
gagcgcgcgcgcc

SEQ ID NO: 44167 - RNA, 14 nt, Homo sapiens
gagcgcgcgcgccc

SEQ ID NO: 44168 - RNA, 19 nt, Homo sapiens
gagcgcgcgcgcccucugg

SEQ ID NO: 44169 - RNA, 20 nt, Homo sapiens
gagcgcgcgcgcccucuggc

SEQ ID NO: 44170 - RNA, 17 nt, Homo sapiens
gagcgcuaccucuccag

SEQ ID NO: 44171 - RNA, 20 nt, Homo sapiens
gagcggaccuucccagcuag

SEQ ID NO: 44172 - RNA, 15 nt, Homo sapiens
gagcuacaggcccca

SEQ ID NO: 44173 - RNA, 22 nt, Homo sapiens
gagcucccaggaggggcuucug

SEQ ID NO: 44174 - RNA, 20 nt, Homo sapiens
gagcugauaucaugccccug

SEQ ID NO: 44175 - RNA, 18 nt, Homo sapiens
gagcugccucucucaucc

SEQ ID NO: 44176 - RNA, 16 nt, Homo sapiens
gagcugcuagaguucu

SEQ ID NO: 44177 - RNA, 19 nt, Homo sapiens
gagcuguuuucccugaccu

SEQ ID NO: 44178 - RNA, 20 nt, Homo sapiens
gagcuguuuucccugaccuc

SEQ ID NO: 44179 - RNA, 23 nt, Homo sapiens
gagcuugaaauagugucugauga

SEQ ID NO: 44180 - RNA, 21 nt, Homo sapiens
gagcuuuuguagaagucacau

SEQ ID NO: 44181 - RNA, 18 nt, Homo sapiens
gaggaauauuugcaagac

SEQ ID NO: 44182 - RNA, 16 nt, Homo sapiens
gaggaaugaaguacuc

SEQ ID NO: 44183 - RNA, 15 nt, Homo sapiens
gaggacuugggcggg

SEQ ID NO: 44184 - RNA, 16 nt, Homo sapiens
gaggacuugggcggga

SEQ ID NO: 44185 - RNA, 17 nt, Homo sapiens
gaggacuugggcgggac

SEQ ID NO: 44186 - RNA, 16 nt, Homo sapiens
gaggagaaacuggaac

SEQ ID NO: 44187 - RNA, 19 nt, Homo sapiens
gaggagaaacuggaacucu

SEQ ID NO: 44188 - RNA, 18 nt, Homo sapiens
gaggcagagguugcagug

SEQ ID NO: 44189 - RNA, 20 nt, Homo sapiens
gaggcagagguugcagugag

SEQ ID NO: 44190 - RNA, 16 nt, Homo sapiens
gaggcauuugcagcug

SEQ ID NO: 44191 - RNA, 19 nt, Homo sapiens
gaggcggguggaucacuug

SEQ ID NO: 44192 - RNA, 12 nt, Homo sapiens
gaggcugagaug

SEQ ID NO: 44193 - RNA, 19 nt, Homo sapiens
gagggaagccuuggggcug

SEQ ID NO: 44194 - RNA, 18 nt, Homo sapiens
gagggcgcggggcgggga

SEQ ID NO: 44195 - RNA, 15 nt, Homo sapiens
gagggcuaauaucuu

SEQ ID NO: 44196 - RNA, 18 nt, Homo sapiens
gagggcuugaggacuugg

SEQ ID NO: 44197 - RNA, 15 nt, Homo sapiens
gaggggaaggcaaca

SEQ ID NO: 44198 - RNA, 14 nt, Homo sapiens
gaggggcgcucgcu

SEQ ID NO: 44199 - RNA, 15 nt, Homo sapiens
gaggggcgcucgcuu

SEQ ID NO: 44200 - RNA, 18 nt, Homo sapiens
gaggggcgcucgcuuccg

SEQ ID NO: 44201 - RNA, 19 nt, Homo sapiens
gaggggcgcucgcuuccgc

SEQ ID NO: 44202 - RNA, 23 nt, Homo sapiens
gaggggcgcucgcuuccgcaucc

SEQ ID NO: 44203 - RNA, 17 nt, Homo sapiens
gaggggcuucugggcag

SEQ ID NO: 44204 - RNA, 12 nt, Homo sapiens
gagguaccagcc

SEQ ID NO: 44205 - RNA, 17 nt, Homo sapiens
gagguacugagagugaa

SEQ ID NO: 44206 - RNA, 13 nt, Homo sapiens
gaggucucugaac

SEQ ID NO: 44207 - RNA, 15 nt, Homo sapiens
gaguaccauaauucu

SEQ ID NO: 44208 - RNA, 13 nt, Homo sapiens
gagugcaguggcg

SEQ ID NO: 44209 - RNA, 14 nt, Homo sapiens
gagugcaguggcgc

SEQ ID NO: 44210 - RNA, 14 nt, Homo sapiens
gagugccuguaauc

SEQ ID NO: 44211 - RNA, 17 nt, Homo sapiens
gaguggcgcgcgccacc

SEQ ID NO: 44212 - RNA, 16 nt, Homo sapiens
gaguggguuucacaag

SEQ ID NO: 44213 - RNA, 18 nt, Homo sapiens
gaguuccuaaccagccug

SEQ ID NO: 44214 - RNA, 16 nt, Homo sapiens
gaguuccuucugcucc

SEQ ID NO: 44215 - RNA, 16 nt, Homo sapiens
gaguucugucuggacu

SEQ ID NO: 44216 - RNA, 17 nt, Homo sapiens
gaguucugucuggacuu

SEQ ID NO: 44217 - RNA, 12 nt, Homo sapiens
gaguuuggccag

SEQ ID NO: 44218 - RNA, 14 nt, Homo sapiens
gaguuuggccagaa

SEQ ID NO: 44219 - RNA, 11 nt, Homo sapiens
gauaaaucagu

SEQ ID NO: 44220 - RNA, 13 nt, Homo sapiens
gauaauaugagaa

SEQ ID NO: 44221 - RNA, 12 nt, Homo sapiens
gauaaugcuaau

SEQ ID NO: 44222 - RNA, 21 nt, Homo sapiens
gauaccucaacccccauuucu

SEQ ID NO: 44223 - RNA, 22 nt, Homo sapiens
gauagagugggacaguuccuga

SEQ ID NO: 44224 - RNA, 17 nt, Homo sapiens
gauagcagggcauggcu

SEQ ID NO: 44225 - RNA, 13 nt, Homo sapiens
gauaggccauggg

SEQ ID NO: 44226 - RNA, 15 nt, Homo sapiens
gauauaaaagacuga

SEQ ID NO: 44227 - RNA, 15 nt, Homo sapiens
gauaucaugccccug

SEQ ID NO: 44228 - RNA, 18 nt, Homo sapiens
gauaucaugccccuguac

SEQ ID NO: 44229 - RNA, 15 nt, Homo sapiens
gauaucccaggaaaa

SEQ ID NO: 44230 - RNA, 12 nt, Homo sapiens
gauaugauucaa

SEQ ID NO: 44231 - RNA, 15 nt, Homo sapiens
gauaugccuuuuccc

SEQ ID NO: 44232 - RNA, 19 nt, Homo sapiens
gauauucucuagucauuug

SEQ ID NO: 44233 - RNA, 20 nt, Homo sapiens
gauauuuauugauguuuuca

SEQ ID NO: 44234 - RNA, 22 nt, Homo sapiens
gaucaaguuauuuuuaauuugg

SEQ ID NO: 44235 - RNA, 21 nt, Homo sapiens
gaucaguaugaaaaugucauu

SEQ ID NO: 44236 - RNA, 13 nt, Homo sapiens
gaucauugugaag

SEQ ID NO: 44237 - RNA, 19 nt, Homo sapiens
gaucauuucaaaacucauu

SEQ ID NO: 44238 - RNA, 21 nt, Homo sapiens
gaucauuucaaaacucauuuc

SEQ ID NO: 44239 - RNA, 21 nt, Homo sapiens
gauccccguguuacugccuau

SEQ ID NO: 44240 - RNA, 22 nt, Homo sapiens
gauccgcccaucuccgucuccc

SEQ ID NO: 44241 - RNA, 23 nt, Homo sapiens
gauccgcccaucuccgucuccca

SEQ ID NO: 44242 - RNA, 14 nt, Homo sapiens
gauccuggaaauca

SEQ ID NO: 44243 - RNA, 17 nt, Homo sapiens
gaucuggggcucuggga

SEQ ID NO: 44244 - RNA, 15 nt, Homo sapiens
gaucuuuaaaauaca

SEQ ID NO: 44245 - RNA, 11 nt, Homo sapiens
gaugaacuuuu

SEQ ID NO: 44246 - RNA, 11 nt, Homo sapiens
gaugaagaagu

SEQ ID NO: 44247 - RNA, 12 nt, Homo sapiens
gaugaagaaguu

SEQ ID NO: 44248 - RNA, 15 nt, Homo sapiens
gaugaaugucaguug

SEQ ID NO: 44249 - RNA, 15 nt, Homo sapiens
gaugaucuuuaaaau

SEQ ID NO: 44250 - RNA, 22 nt, Homo sapiens
gaugaucuuuaaaauacacacu

SEQ ID NO: 44251 - RNA, 13 nt, Homo sapiens
gaugauguuucgu

SEQ ID NO: 44252 - RNA, 16 nt, Homo sapiens
gaugcaguucugaaga

SEQ ID NO: 44253 - RNA, 12 nt, Homo sapiens
gaugcccacggc

SEQ ID NO: 44254 - RNA, 13 nt, Homo sapiens
gaugcccacggcu

SEQ ID NO: 44255 - RNA, 16 nt, Homo sapiens
gaugcccacggcugga

SEQ ID NO: 44256 - RNA, 21 nt, Homo sapiens
gaugccccagggaccuuugua

SEQ ID NO: 44257 - RNA, 22 nt, Homo sapiens
gauggaaguugcagugagcuga

SEQ ID NO: 44258 - RNA, 20 nt, Homo sapiens
gauggcaggaggcauccaaa

SEQ ID NO: 44259 - RNA, 19 nt, Homo sapiens
gaugggagaaucacuugaa

SEQ ID NO: 44260 - RNA, 20 nt, Homo sapiens
gaugggagaaucacuugaac

SEQ ID NO: 44261 - RNA, 23 nt, Homo sapiens
gauggguuugacaagguucuucc

SEQ ID NO: 44262 - RNA, 17 nt, Homo sapiens
gaugguucccuugauga

SEQ ID NO: 44263 - RNA, 21 nt, Homo sapiens
gaugguucccuugaugaagaa

SEQ ID NO: 44264 - RNA, 23 nt, Homo sapiens
gauguuuagaaacacaacuauau

SEQ ID NO: 44265 - RNA, 15 nt, Homo sapiens
gauguuucauaagaa

SEQ ID NO: 44266 - RNA, 12 nt, Homo sapiens
gauuaaacuuaa

SEQ ID NO: 44267 - RNA, 13 nt, Homo sapiens
gauuaaacuuaau

SEQ ID NO: 44268 - RNA, 18 nt, Homo sapiens
gauuaacucuaccugcac

SEQ ID NO: 44269 - RNA, 18 nt, Homo sapiens
gauuacccucugggucuc

SEQ ID NO: 44270 - RNA, 20 nt, Homo sapiens
gauuauauauauuuuuuucu

SEQ ID NO: 44271 - RNA, 13 nt, Homo sapiens
gauucaauuuuaa

SEQ ID NO: 44272 - RNA, 23 nt, Homo sapiens
gauuccaccuacaugagguacug

SEQ ID NO: 44273 - RNA, 15 nt, Homo sapiens
gauucccagccagca

SEQ ID NO: 44274 - RNA, 18 nt, Homo sapiens
gauucccagccagcacag

SEQ ID NO: 44275 - RNA, 16 nt, Homo sapiens
gauucccugagcagga

SEQ ID NO: 44276 - RNA, 16 nt, Homo sapiens
gauuccucacuuugaa

SEQ ID NO: 44277 - RNA, 13 nt, Homo sapiens
gauucuauguuaa

SEQ ID NO: 44278 - RNA, 21 nt, Homo sapiens
gauucucuuuauucagccccg

SEQ ID NO: 44279 - RNA, 18 nt, Homo sapiens
gauugagaaggagcuccc

SEQ ID NO: 44280 - RNA, 20 nt, Homo sapiens
gauugugccccugcacucca

SEQ ID NO: 44281 - RNA, 20 nt, Homo sapiens
gauugugggauacuauuuaa

SEQ ID NO: 44282 - RNA, 15 nt, Homo sapiens
gauuuaacagaaaug

SEQ ID NO: 44283 - RNA, 14 nt, Homo sapiens
gauuucaugccugg

SEQ ID NO: 44284 - RNA, 23 nt, Homo sapiens
gauuucaugccuggugcuuccaa

SEQ ID NO: 44285 - RNA, 12 nt, Homo sapiens
gauuucauucaa

SEQ ID NO: 44286 - RNA, 15 nt, Homo sapiens
gauuucuguuuagau

SEQ ID NO: 44287 - RNA, 15 nt, Homo sapiens
gauuuguaauauuuc

SEQ ID NO: 44288 - RNA, 16 nt, Homo sapiens
gauuuuaugcuuuaaa

SEQ ID NO: 44289 - RNA, 16 nt, Homo sapiens
gauuuugcuguagaag

SEQ ID NO: 44290 - RNA, 20 nt, Homo sapiens
gcaaaauuuuuucucuagga

SEQ ID NO: 44291 - RNA, 23 nt, Homo sapiens
gcaaagacuaugaggaauauuug

SEQ ID NO: 44292 - RNA, 20 nt, Homo sapiens
gcaaaguaucccuacuguaa

SEQ ID NO: 44293 - RNA, 14 nt, Homo sapiens
gcaaaugagccgga

SEQ ID NO: 44294 - RNA, 17 nt, Homo sapiens
gcaaauggccaaugaga

SEQ ID NO: 44295 - RNA, 16 nt, Homo sapiens
gcaaauguuaugcaua

SEQ ID NO: 44296 - RNA, 16 nt, Homo sapiens
gcaaauuccaauacau

SEQ ID NO: 44297 - RNA, 17 nt, Homo sapiens
gcaaauuccaauacauu

SEQ ID NO: 44298 - RNA, 22 nt, Homo sapiens
gcaaauugucacaggacagccc

SEQ ID NO: 44299 - RNA, 20 nt, Homo sapiens
gcaacaugccagccacugug

SEQ ID NO: 44300 - RNA, 21 nt, Homo sapiens
gcaacaugccagccacuguga

SEQ ID NO: 44301 - RNA, 11 nt, Homo sapiens
gcaacccaaau

SEQ ID NO: 44302 - RNA, 19 nt, Homo sapiens
gcaaccccaucauccucag

SEQ ID NO: 44303 - RNA, 12 nt, Homo sapiens
gcaaccuccacc

SEQ ID NO: 44304 - RNA, 15 nt, Homo sapiens
gcaaccuccaccuuc

SEQ ID NO: 44305 - RNA, 17 nt, Homo sapiens
gcaaccuccaccuucug

SEQ ID NO: 44306 - RNA, 19 nt, Homo sapiens
gcaaccuccaccuucuggg

SEQ ID NO: 44307 - RNA, 20 nt, Homo sapiens
gcaaccuccaccuucugggu

SEQ ID NO: 44308 - RNA, 19 nt, Homo sapiens
gcaaccuuuggaugcacuu

SEQ ID NO: 44309 - RNA, 23 nt, Homo sapiens
gcaacgcaggcccccaggugcca

SEQ ID NO: 44310 - RNA, 23 nt, Homo sapiens
gcacacucucccauuauauuuau

SEQ ID NO: 44311 - RNA, 21 nt, Homo sapiens
gcacagccucuuagaugcagu

SEQ ID NO: 44312 - RNA, 17 nt, Homo sapiens
gcacaucuguuuuguaa

SEQ ID NO: 44313 - RNA, 13 nt, Homo sapiens
gcaccaaucauga

SEQ ID NO: 44314 - RNA, 20 nt, Homo sapiens
gcaccgcuguacgcgagcgc

SEQ ID NO: 44315 - RNA, 11 nt, Homo sapiens
gcaccugcagg

SEQ ID NO: 44316 - RNA, 17 nt, Homo sapiens
gcaccuguaaucccagc

SEQ ID NO: 44317 - RNA, 17 nt, Homo sapiens
gcaccugugccgucccc

SEQ ID NO: 44318 - RNA, 21 nt, Homo sapiens
gcaccuuuagaauauuaaaaa

SEQ ID NO: 44319 - RNA, 14 nt, Homo sapiens
gcacgauuucuguu

SEQ ID NO: 44320 - RNA, 15 nt, Homo sapiens
gcacuaaucaauacu

SEQ ID NO: 44321 - RNA, 16 nt, Homo sapiens
gcacuaaucaauacuu

SEQ ID NO: 44322 - RNA, 17 nt, Homo sapiens
gcacuaguauuucuaug

SEQ ID NO: 44323 - RNA, 22 nt, Homo sapiens
gcacuaguauuucuaugaaaua

SEQ ID NO: 44324 - RNA, 14 nt, Homo sapiens
gcacuccagccuga

SEQ ID NO: 44325 - RNA, 18 nt, Homo sapiens
gcacuccagccugagcga

SEQ ID NO: 44326 - RNA, 14 nt, Homo sapiens
gcacuuacaauuuu

SEQ ID NO: 44327 - RNA, 20 nt, Homo sapiens
gcacuuauuuauuguuguug

SEQ ID NO: 44328 - RNA, 21 nt, Homo sapiens
gcacuuauuuauuguuguugg

SEQ ID NO: 44329 - RNA, 15 nt, Homo sapiens
gcacuugggacaaaa

SEQ ID NO: 44330 - RNA, 16 nt, Homo sapiens
gcacuuuaaacauuua

SEQ ID NO: 44331 - RNA, 18 nt, Homo sapiens
gcacuuuaacacaguguc

SEQ ID NO: 44332 - RNA, 20 nt, Homo sapiens
gcacuuucccucuuggugcc

SEQ ID NO: 44333 - RNA, 22 nt, Homo sapiens
gcacuuucccucuuggugccuc

SEQ ID NO: 44334 - RNA, 17 nt, Homo sapiens
gcacuuugggaggcuga

SEQ ID NO: 44335 - RNA, 12 nt, Homo sapiens
gcagaacaguga

SEQ ID NO: 44336 - RNA, 14 nt, Homo sapiens
gcagaagacaguau

SEQ ID NO: 44337 - RNA, 17 nt, Homo sapiens
gcagaagcaacccaaau

SEQ ID NO: 44338 - RNA, 14 nt, Homo sapiens
gcagacucugguca

SEQ ID NO: 44339 - RNA, 20 nt, Homo sapiens
gcagagacgggguuugccau

SEQ ID NO: 44340 - RNA, 22 nt, Homo sapiens
gcagagagguuucgauauuuau

SEQ ID NO: 44341 - RNA, 19 nt, Homo sapiens
gcagagguugcagugagcc

SEQ ID NO: 44342 - RNA, 13 nt, Homo sapiens
gcagauaaacagu

SEQ ID NO: 44343 - RNA, 23 nt, Homo sapiens
gcagauguaauagaaauaaaccu

SEQ ID NO: 44344 - RNA, 19 nt, Homo sapiens
gcagauuuaagauauguaa

SEQ ID NO: 44345 - RNA, 23 nt, Homo sapiens
gcagauuucuuuccauugugggc

SEQ ID NO: 44346 - RNA, 23 nt, Homo sapiens
gcagccaaccuaagcaagauccc

SEQ ID NO: 44347 - RNA, 22 nt, Homo sapiens
gcagccaugugauuacccucug

SEQ ID NO: 44348 - RNA, 20 nt, Homo sapiens
gcagcccugcugcugccugc

SEQ ID NO: 44349 - RNA, 21 nt, Homo sapiens
gcagcgaguacuucccgcugu

SEQ ID NO: 44350 - RNA, 22 nt, Homo sapiens
gcagcgaguacuucccgcuguu

SEQ ID NO: 44351 - RNA, 14 nt, Homo sapiens
gcagcucaggcugg

SEQ ID NO: 44352 - RNA, 20 nt, Homo sapiens
gcagcucaggcuggcaccgc

SEQ ID NO: 44353 - RNA, 22 nt, Homo sapiens
gcagcucuaaaugucaaucagc

SEQ ID NO: 44354 - RNA, 14 nt, Homo sapiens
gcagcuuauucaca

SEQ ID NO: 44355 - RNA, 17 nt, Homo sapiens
gcaggaccaucccggcc

SEQ ID NO: 44356 - RNA, 19 nt, Homo sapiens
gcaggaccaucccggccgg

SEQ ID NO: 44357 - RNA, 20 nt, Homo sapiens
gcaggaccaucccggccggc

SEQ ID NO: 44358 - RNA, 18 nt, Homo sapiens
gcaggauagagugggaca

SEQ ID NO: 44359 - RNA, 12 nt, Homo sapiens
gcaggcagcagg

SEQ ID NO: 44360 - RNA, 13 nt, Homo sapiens
gcaggcaucgcca

SEQ ID NO: 44361 - RNA, 18 nt, Homo sapiens
gcaggcccccaggugcca

SEQ ID NO: 44362 - RNA, 12 nt, Homo sapiens
gcaggcgugacc

SEQ ID NO: 44363 - RNA, 13 nt, Homo sapiens
gcaggcgugaccu

SEQ ID NO: 44364 - RNA, 14 nt, Homo sapiens
gcaggcgugaccug

SEQ ID NO: 44365 - RNA, 22 nt, Homo sapiens
gcaggcgugaccugacagccca

SEQ ID NO: 44366 - RNA, 23 nt, Homo sapiens
gcaggcgugaccugacagcccaa

SEQ ID NO: 44367 - RNA, 13 nt, Homo sapiens
gcagggacuugaa

SEQ ID NO: 44368 - RNA, 18 nt, Homo sapiens
gcagggugaacugcagcg

SEQ ID NO: 44369 - RNA, 17 nt, Homo sapiens
gcaggucacacaaccug

SEQ ID NO: 44370 - RNA, 19 nt, Homo sapiens
gcaggucacacaaccuguc

SEQ ID NO: 44371 - RNA, 13 nt, Homo sapiens
gcagugaggcgga

SEQ ID NO: 44372 - RNA, 12 nt, Homo sapiens
gcagugcuuggc

SEQ ID NO: 44373 - RNA, 14 nt, Homo sapiens
gcagugcuuggccc

SEQ ID NO: 44374 - RNA, 16 nt, Homo sapiens
gcagugcuuggcccag

SEQ ID NO: 44375 - RNA, 19 nt, Homo sapiens
gcagugcuuggcccaggag

SEQ ID NO: 44376 - RNA, 19 nt, Homo sapiens
gcaguggugguuuucuguu

SEQ ID NO: 44377 - RNA, 18 nt, Homo sapiens
gcaguucugaagaagaug

SEQ ID NO: 44378 - RNA, 17 nt, Homo sapiens
gcaguuguugcccacag

SEQ ID NO: 44379 - RNA, 17 nt, Homo sapiens
gcauacugccuuguuua

SEQ ID NO: 44380 - RNA, 18 nt, Homo sapiens
gcauaguaccucugcuau

SEQ ID NO: 44381 - RNA, 19 nt, Homo sapiens
gcauaguaccucugcuauu

SEQ ID NO: 44382 - RNA, 22 nt, Homo sapiens
gcauaguaccucugcuauuugc

SEQ ID NO: 44383 - RNA, 18 nt, Homo sapiens
gcauauugauaauaaaau

SEQ ID NO: 44384 - RNA, 12 nt, Homo sapiens
gcauauuuuauu

SEQ ID NO: 44385 - RNA, 21 nt, Homo sapiens
gcaucaauuuuucuuauuuca

SEQ ID NO: 44386 - RNA, 14 nt, Homo sapiens
gcaucacaguuuug

SEQ ID NO: 44387 - RNA, 23 nt, Homo sapiens
gcaucagcugcugaaacaacaaa

SEQ ID NO: 44388 - RNA, 12 nt, Homo sapiens
gcaucaugcauc

SEQ ID NO: 44389 - RNA, 14 nt, Homo sapiens
gcauccuagucucu

SEQ ID NO: 44390 - RNA, 16 nt, Homo sapiens
gcauccuagucucuau

SEQ ID NO: 44391 - RNA, 21 nt, Homo sapiens
gcauccuagucucuaucauua

SEQ ID NO: 44392 - RNA, 16 nt, Homo sapiens
gcaucucauuuauaau

SEQ ID NO: 44393 - RNA, 15 nt, Homo sapiens
gcaucucugaacauu

SEQ ID NO: 44394 - RNA, 16 nt, Homo sapiens
gcaucucugaacauuu

SEQ ID NO: 44395 - RNA, 19 nt, Homo sapiens
gcaugggccuagcccacug

SEQ ID NO: 44396 - RNA, 20 nt, Homo sapiens
gcaugggccuagcccacugg

SEQ ID NO: 44397 - RNA, 19 nt, Homo sapiens
gcaugguggcgcgcaccug

SEQ ID NO: 44398 - RNA, 19 nt, Homo sapiens
gcauguaugacgugacugg

SEQ ID NO: 44399 - RNA, 20 nt, Homo sapiens
gcauguaugacgugacuggc

SEQ ID NO: 44400 - RNA, 21 nt, Homo sapiens
gcaugucagacagaacuugaa

SEQ ID NO: 44401 - RNA, 24 nt, Homo sapiens
gcauuauauuuauuacuguaagaa

SEQ ID NO: 44402 - RNA, 16 nt, Homo sapiens
gcauuaucuagauacu

SEQ ID NO: 44403 - RNA, 14 nt, Homo sapiens
gcauucaaauguau

SEQ ID NO: 44404 - RNA, 14 nt, Homo sapiens
gcauuccaacuauc

SEQ ID NO: 44405 - RNA, 16 nt, Homo sapiens
gcauuguaacuuauga

SEQ ID NO: 44406 - RNA, 17 nt, Homo sapiens
gcauuguaacuuaugaa

SEQ ID NO: 44407 - RNA, 14 nt, Homo sapiens
gcauuuaauuuauu

SEQ ID NO: 44408 - RNA, 19 nt, Homo sapiens
gcauuuggugguuucagaa

SEQ ID NO: 44409 - RNA, 15 nt, Homo sapiens
gcauuuguuugaacu

SEQ ID NO: 44410 - RNA, 15 nt, Homo sapiens
gccaaccugggggcu

SEQ ID NO: 44411 - RNA, 20 nt, Homo sapiens
gccaacuggggugggugggg

SEQ ID NO: 44412 - RNA, 21 nt, Homo sapiens
gccaacugggguggguggggc

SEQ ID NO: 44413 - RNA, 22 nt, Homo sapiens
gccaacugggguggguggggca

SEQ ID NO: 44414 - RNA, 23 nt, Homo sapiens
gccaacugggguggguggggcag

SEQ ID NO: 44415 - RNA, 11 nt, Homo sapiens
gccaaggcugg

SEQ ID NO: 44416 - RNA, 13 nt, Homo sapiens
gccaaggcuggag

SEQ ID NO: 44417 - RNA, 15 nt, Homo sapiens
gccaaggcuggagug

SEQ ID NO: 44418 - RNA, 19 nt, Homo sapiens
gccaaggcuggagugcagu

SEQ ID NO: 44419 - RNA, 23 nt, Homo sapiens
gccaaggcuggagugcaguggcg

SEQ ID NO: 44420 - RNA, 12 nt, Homo sapiens
gccaauuuacuu

SEQ ID NO: 44421 - RNA, 16 nt, Homo sapiens
gccaccaaacccggcc

SEQ ID NO: 44422 - RNA, 13 nt, Homo sapiens
gccaccacgccca

SEQ ID NO: 44423 - RNA, 15 nt, Homo sapiens
gccaccacgcccagc

SEQ ID NO: 44424 - RNA, 16 nt, Homo sapiens
gccaccacgcccagcu

SEQ ID NO: 44425 - RNA, 15 nt, Homo sapiens
gccaccuccugccuc

SEQ ID NO: 44426 - RNA, 11 nt, Homo sapiens
gccacgcucug

SEQ ID NO: 44427 - RNA, 16 nt, Homo sapiens
gccacgcucugggucg

SEQ ID NO: 44428 - RNA, 19 nt, Homo sapiens
gccacgcucugggucgccg

SEQ ID NO: 44429 - RNA, 20 nt, Homo sapiens
gccacgcucugggucgccgg

SEQ ID NO: 44430 - RNA, 20 nt, Homo sapiens
gccacugugauagaggcuga

SEQ ID NO: 44431 - RNA, 13 nt, Homo sapiens
gccacuucacuuu

SEQ ID NO: 44432 - RNA, 13 nt, Homo sapiens
gccagaagucaag

SEQ ID NO: 44433 - RNA, 18 nt, Homo sapiens
gccagacaucaacagaua

SEQ ID NO: 44434 - RNA, 18 nt, Homo sapiens
gccagacuggcacaguuu

SEQ ID NO: 44435 - RNA, 13 nt, Homo sapiens
gccagcaaauucg

SEQ ID NO: 44436 - RNA, 14 nt, Homo sapiens
gccagcaaauucgc

SEQ ID NO: 44437 - RNA, 18 nt, Homo sapiens
gccagcccucuucugaca

SEQ ID NO: 44438 - RNA, 12 nt, Homo sapiens
gccaggcggcug

SEQ ID NO: 44439 - RNA, 14 nt, Homo sapiens
gccagguaccuucu

SEQ ID NO: 44440 - RNA, 23 nt, Homo sapiens
gccagugcuuuaauggcauguca

SEQ ID NO: 44441 - RNA, 18 nt, Homo sapiens
gccauaauuacuauguca

SEQ ID NO: 44442 - RNA, 20 nt, Homo sapiens
gccauaauuacuaugucauu

SEQ ID NO: 44443 - RNA, 18 nt, Homo sapiens
gccauagucauucugccu

SEQ ID NO: 44444 - RNA, 21 nt, Homo sapiens
gccauagucauucugccugcc

SEQ ID NO: 44445 - RNA, 12 nt, Homo sapiens
gccaucauuuac

SEQ ID NO: 44446 - RNA, 17 nt, Homo sapiens
gccaugcuggccaggcu

SEQ ID NO: 44447 - RNA, 18 nt, Homo sapiens
gccaugcuggccaggcug

SEQ ID NO: 44448 - RNA, 19 nt, Homo sapiens
gccaugcuggccaggcugg

SEQ ID NO: 44449 - RNA, 21 nt, Homo sapiens
gccaugcuggccaggcugguc

SEQ ID NO: 44450 - RNA, 23 nt, Homo sapiens
gccaugcuggccaggcuggucuc

SEQ ID NO: 44451 - RNA, 20 nt, Homo sapiens
gccauggagguuaagcacuu

SEQ ID NO: 44452 - RNA, 16 nt, Homo sapiens
gccaugugcuaguaau

SEQ ID NO: 44453 - RNA, 13 nt, Homo sapiens
gccauucuugcug

SEQ ID NO: 44454 - RNA, 23 nt, Homo sapiens
gcccaacuguuauagguuguugg

SEQ ID NO: 44455 - RNA, 19 nt, Homo sapiens
gcccaaggguggguggggu

SEQ ID NO: 44456 - RNA, 21 nt, Homo sapiens
gcccaagggugggugggguga

SEQ ID NO: 44457 - RNA, 16 nt, Homo sapiens
gcccaccgcaggguga

SEQ ID NO: 44458 - RNA, 13 nt, Homo sapiens
gcccacggcugga

SEQ ID NO: 44459 - RNA, 18 nt, Homo sapiens
gcccacggcuggagcugc

SEQ ID NO: 44460 - RNA, 18 nt, Homo sapiens
gcccacuuccucccggcc

SEQ ID NO: 44461 - RNA, 22 nt, Homo sapiens
gcccacuuccucccggccgcgc

SEQ ID NO: 44462 - RNA, 17 nt, Homo sapiens
gcccaggaguuuggcca

SEQ ID NO: 44463 - RNA, 18 nt, Homo sapiens
gcccaggaguuuggccag

SEQ ID NO: 44464 - RNA, 22 nt, Homo sapiens
gcccaggaguuuggccagaagu

SEQ ID NO: 44465 - RNA, 16 nt, Homo sapiens
gcccauccugccccug

SEQ ID NO: 44466 - RNA, 20 nt, Homo sapiens
gcccauccugccccugagcc

SEQ ID NO: 44467 - RNA, 22 nt, Homo sapiens
gcccauccugccccugagccca

SEQ ID NO: 44468 - RNA, 16 nt, Homo sapiens
gcccaucuccgucucc

SEQ ID NO: 44469 - RNA, 13 nt, Homo sapiens
gccccaauucgau

SEQ ID NO: 44470 - RNA, 15 nt, Homo sapiens
gccccaauucgaucc

SEQ ID NO: 44471 - RNA, 14 nt, Homo sapiens
gccccaggcggguc

SEQ ID NO: 44472 - RNA, 15 nt, Homo sapiens
gccccaucugguccu

SEQ ID NO: 44473 - RNA, 16 nt, Homo sapiens
gccccaucugguccua

SEQ ID NO: 44474 - RNA, 18 nt, Homo sapiens
gcccccauuguggucaca

SEQ ID NO: 44475 - RNA, 11 nt, Homo sapiens
gcccccgggcc

SEQ ID NO: 44476 - RNA, 12 nt, Homo sapiens
gcccccgggccg

SEQ ID NO: 44477 - RNA, 13 nt, Homo sapiens
gcccccgggccga

SEQ ID NO: 44478 - RNA, 17 nt, Homo sapiens
gcccccgggccgacgga

SEQ ID NO: 44479 - RNA, 19 nt, Homo sapiens
gcccccgggccgacggagc

SEQ ID NO: 44480 - RNA, 21 nt, Homo sapiens
gcccccgggccgacggagccg

SEQ ID NO: 44481 - RNA, 12 nt, Homo sapiens
gccccgggagug

SEQ ID NO: 44482 - RNA, 14 nt, Homo sapiens
gccccgggaguggc

SEQ ID NO: 44483 - RNA, 12 nt, Homo sapiens
gccccggggagg

SEQ ID NO: 44484 - RNA, 14 nt, Homo sapiens
gccccggggagggg

SEQ ID NO: 44485 - RNA, 17 nt, Homo sapiens
gccccggggaggggcgc

SEQ ID NO: 44486 - RNA, 19 nt, Homo sapiens
gccccggggaggggcgcuc

SEQ ID NO: 44487 - RNA, 20 nt, Homo sapiens
gccccggggaggggcgcucg

SEQ ID NO: 44488 - RNA, 21 nt, Homo sapiens
gccccggggaggggcgcucgc

SEQ ID NO: 44489 - RNA, 22 nt, Homo sapiens
gccccggggaggggcgcucgcu

SEQ ID NO: 44490 - RNA, 18 nt, Homo sapiens
gccccgugggguuccucc

SEQ ID NO: 44491 - RNA, 11 nt, Homo sapiens
gccccugagcc

SEQ ID NO: 44492 - RNA, 12 nt, Homo sapiens
gccccugagccc

SEQ ID NO: 44493 - RNA, 13 nt, Homo sapiens
gccccugagccca

SEQ ID NO: 44494 - RNA, 17 nt, Homo sapiens
gccccugcacuccagcc

SEQ ID NO: 44495 - RNA, 21 nt, Homo sapiens
gccccugcacuccagccugag

SEQ ID NO: 44496 - RNA, 22 nt, Homo sapiens
gccccugccaccuccugccuca

SEQ ID NO: 44497 - RNA, 12 nt, Homo sapiens
gccccuugggca

SEQ ID NO: 44498 - RNA, 13 nt, Homo sapiens
gccccuugggcag

SEQ ID NO: 44499 - RNA, 16 nt, Homo sapiens
gcccucuggcugcugg

SEQ ID NO: 44500 - RNA, 21 nt, Homo sapiens
gcccugaaagucccagaucaa

SEQ ID NO: 44501 - RNA, 14 nt, Homo sapiens
gcccugccaugcuc

SEQ ID NO: 44502 - RNA, 16 nt, Homo sapiens
gcccugccaugcucuc

SEQ ID NO: 44503 - RNA, 14 nt, Homo sapiens
gcccugcuuuugcu

SEQ ID NO: 44504 - RNA, 16 nt, Homo sapiens
gcccuggccuagcaua

SEQ ID NO: 44505 - RNA, 13 nt, Homo sapiens
gcccugugcggcc

SEQ ID NO: 44506 - RNA, 14 nt, Homo sapiens
gcccugugcggccu

SEQ ID NO: 44507 - RNA, 16 nt, Homo sapiens
gcccugugcggccugg

SEQ ID NO: 44508 - RNA, 17 nt, Homo sapiens
gcccugugcggccuggu

SEQ ID NO: 44509 - RNA, 18 nt, Homo sapiens
gcccugugcggccugguc

SEQ ID NO: 44510 - RNA, 19 nt, Homo sapiens
gcccugugcggccuggucu

SEQ ID NO: 44511 - RNA, 18 nt, Homo sapiens
gcccuuacguccuuccac

SEQ ID NO: 44512 - RNA, 19 nt, Homo sapiens
gcccuuacguccuuccacu

SEQ ID NO: 44513 - RNA, 13 nt, Homo sapiens
gcccuucauguac

SEQ ID NO: 44514 - RNA, 17 nt, Homo sapiens
gcccuuccccuucccac

SEQ ID NO: 44515 - RNA, 23 nt, Homo sapiens
gcccuuccccuucccacacuguc

SEQ ID NO: 44516 - RNA, 12 nt, Homo sapiens
gccgacggagcc

SEQ ID NO: 44517 - RNA, 14 nt, Homo sapiens
gccgacggagccgg

SEQ ID NO: 44518 - RNA, 15 nt, Homo sapiens
gccgacggagccggg

SEQ ID NO: 44519 - RNA, 17 nt, Homo sapiens
gccgacggagccgggaa

SEQ ID NO: 44520 - RNA, 21 nt, Homo sapiens
gccgacggagccgggaaagaa

SEQ ID NO: 44521 - RNA, 15 nt, Homo sapiens
gccgagauugugccc

SEQ ID NO: 44522 - RNA, 19 nt, Homo sapiens
gccgcgcuccucggacggc

SEQ ID NO: 44523 - RNA, 21 nt, Homo sapiens
gccgcgcuccucggacggcuc

SEQ ID NO: 44524 - RNA, 22 nt, Homo sapiens
gccgcgcuccucggacggcucc

SEQ ID NO: 44525 - RNA, 13 nt, Homo sapiens
gccgcgcugcgcg

SEQ ID NO: 44526 - RNA, 14 nt, Homo sapiens
gccgcgcugcgcgc

SEQ ID NO: 44527 - RNA, 15 nt, Homo sapiens
gccgcgcugcgcgcc

SEQ ID NO: 44528 - RNA, 16 nt, Homo sapiens
gccgcgcugcgcgccg

SEQ ID NO: 44529 - RNA, 18 nt, Homo sapiens
gccgcgcugcgcgccgcg

SEQ ID NO: 44530 - RNA, 19 nt, Homo sapiens
gccgcgcugcgcgccgcgc

SEQ ID NO: 44531 - RNA, 20 nt, Homo sapiens
gccgcgcugcgcgccgcgcu

SEQ ID NO: 44532 - RNA, 15 nt, Homo sapiens
gccgcuuaagcuuuc

SEQ ID NO: 44533 - RNA, 14 nt, Homo sapiens
gccggagccccuug

SEQ ID NO: 44534 - RNA, 24 nt, Homo sapiens
gccggagccccuugggcaggucac

SEQ ID NO: 44535 - RNA, 13 nt, Homo sapiens
gccggagccucca

SEQ ID NO: 44536 - RNA, 14 nt, Homo sapiens
gccggagccuccag

SEQ ID NO: 44537 - RNA, 15 nt, Homo sapiens
gccggagccuccagc

SEQ ID NO: 44538 - RNA, 18 nt, Homo sapiens
gccggagccuccagcugc

SEQ ID NO: 44539 - RNA, 20 nt, Homo sapiens
gccggagccuccagcugccc

SEQ ID NO: 44540 - RNA, 21 nt, Homo sapiens
gccggagccuccagcugcccc

SEQ ID NO: 44541 - RNA, 22 nt, Homo sapiens
gccggagccuccagcugccccg

SEQ ID NO: 44542 - RNA, 23 nt, Homo sapiens
gccggagccuccagcugccccgg

SEQ ID NO: 44543 - RNA, 12 nt, Homo sapiens
gccggcgcgcuc

SEQ ID NO: 44544 - RNA, 14 nt, Homo sapiens
gccggcgcgcucau

SEQ ID NO: 44545 - RNA, 23 nt, Homo sapiens
gccggcgcgcucaucccacccgc

SEQ ID NO: 44546 - RNA, 18 nt, Homo sapiens
gccgggaaagaagagccg

SEQ ID NO: 44547 - RNA, 19 nt, Homo sapiens
gccgggaaagaagagccgg

SEQ ID NO: 44548 - RNA, 20 nt, Homo sapiens
gccgggaaagaagagccgga

SEQ ID NO: 44549 - RNA, 21 nt, Homo sapiens
gccgggaaagaagagccggag

SEQ ID NO: 44550 - RNA, 15 nt, Homo sapiens
gccgggcgcgguggc

SEQ ID NO: 44551 - RNA, 18 nt, Homo sapiens
gccgggcgcgguggcuca

SEQ ID NO: 44552 - RNA, 17 nt, Homo sapiens
gccgggcguggugguga

SEQ ID NO: 44553 - RNA, 15 nt, Homo sapiens
gccgguccuugcugc

SEQ ID NO: 44554 - RNA, 16 nt, Homo sapiens
gccgguccuugcugca

SEQ ID NO: 44555 - RNA, 17 nt, Homo sapiens
gccgguccuugcugcac

SEQ ID NO: 44556 - RNA, 20 nt, Homo sapiens
gccguccccagagcuacagg

SEQ ID NO: 44557 - RNA, 12 nt, Homo sapiens
gccgugggccug

SEQ ID NO: 44558 - RNA, 23 nt, Homo sapiens
gccgugggccugagaccaaggcc

SEQ ID NO: 44559 - RNA, 16 nt, Homo sapiens
gccuaagugcagcccc

SEQ ID NO: 44560 - RNA, 17 nt, Homo sapiens
gccuaagugcagccccg

SEQ ID NO: 44561 - RNA, 16 nt, Homo sapiens
gccuaucagcauuuua

SEQ ID NO: 44562 - RNA, 23 nt, Homo sapiens
gccucaaucaguauucauauuua

SEQ ID NO: 44563 - RNA, 14 nt, Homo sapiens
gccucaccccuugc

SEQ ID NO: 44564 - RNA, 15 nt, Homo sapiens
gccucaccccuugcc

SEQ ID NO: 44565 - RNA, 20 nt, Homo sapiens
gccucagaaaacaaggauga

SEQ ID NO: 44566 - RNA, 11 nt, Homo sapiens
gccucagcucu

SEQ ID NO: 44567 - RNA, 13 nt, Homo sapiens
gccucagcucuca

SEQ ID NO: 44568 - RNA, 15 nt, Homo sapiens
gccuccagcugcccc

SEQ ID NO: 44569 - RNA, 16 nt, Homo sapiens
gccuccagcugccccg

SEQ ID NO: 44570 - RNA, 17 nt, Homo sapiens
gccuccagcugccccgg

SEQ ID NO: 44571 - RNA, 18 nt, Homo sapiens
gccuccagcugccccggg

SEQ ID NO: 44572 - RNA, 20 nt, Homo sapiens
gccuccagcugccccgggga

SEQ ID NO: 44573 - RNA, 12 nt, Homo sapiens
gccuccgcuacu

SEQ ID NO: 44574 - RNA, 20 nt, Homo sapiens
gccuccgcuacuuccagggc

SEQ ID NO: 44575 - RNA, 13 nt, Homo sapiens
gccuccucucuca

SEQ ID NO: 44576 - RNA, 23 nt, Homo sapiens
gccucuauugccaugagaguucu

SEQ ID NO: 44577 - RNA, 18 nt, Homo sapiens
gccugaaagaggaaugaa

SEQ ID NO: 44578 - RNA, 19 nt, Homo sapiens
gccugaaagaggaaugaag

SEQ ID NO: 44579 - RNA, 15 nt, Homo sapiens
gccugagaccaaggc

SEQ ID NO: 44580 - RNA, 16 nt, Homo sapiens
gccugagaccaaggcc

SEQ ID NO: 44581 - RNA, 21 nt, Homo sapiens
gccugagaccaaggcccccgg

SEQ ID NO: 44582 - RNA, 17 nt, Homo sapiens
gccugagcggaccuucc

SEQ ID NO: 44583 - RNA, 14 nt, Homo sapiens
gccugcaauauuug

SEQ ID NO: 44584 - RNA, 12 nt, Homo sapiens
gccugcucgccc

SEQ ID NO: 44585 - RNA, 13 nt, Homo sapiens
gccugcucgccca

SEQ ID NO: 44586 - RNA, 14 nt, Homo sapiens
gccugcucgcccac

SEQ ID NO: 44587 - RNA, 21 nt, Homo sapiens
gccugcucgcccacuuccucc

SEQ ID NO: 44588 - RNA, 22 nt, Homo sapiens
gccugcuggauguggagggggc

SEQ ID NO: 44589 - RNA, 19 nt, Homo sapiens
gccuggauggcugccucac

SEQ ID NO: 44590 - RNA, 11 nt, Homo sapiens
gccuggcuggg

SEQ ID NO: 44591 - RNA, 17 nt, Homo sapiens
gccuggcugggaguggc

SEQ ID NO: 44592 - RNA, 18 nt, Homo sapiens
gccuggcugggaguggca

SEQ ID NO: 44593 - RNA, 12 nt, Homo sapiens
gccugggugaca

SEQ ID NO: 44594 - RNA, 13 nt, Homo sapiens
gccugggugacag

SEQ ID NO: 44595 - RNA, 20 nt, Homo sapiens
gccuggucaacauggugaaa

SEQ ID NO: 44596 - RNA, 18 nt, Homo sapiens
gccuggugcuuccaaaua

SEQ ID NO: 44597 - RNA, 16 nt, Homo sapiens
gccuguaaucccagca

SEQ ID NO: 44598 - RNA, 20 nt, Homo sapiens
gccuguaaucccagcacuuu

SEQ ID NO: 44599 - RNA, 17 nt, Homo sapiens
gccuuggauacuccaug

SEQ ID NO: 44600 - RNA, 18 nt, Homo sapiens
gccuuggggcugaugcag

SEQ ID NO: 44601 - RNA, 16 nt, Homo sapiens
gccuugguauagcaua

SEQ ID NO: 44602 - RNA, 13 nt, Homo sapiens
gcgacagugagac

SEQ ID NO: 44603 - RNA, 14 nt, Homo sapiens
gcgagccccaggcg

SEQ ID NO: 44604 - RNA, 12 nt, Homo sapiens
gcgagcgcgcgc

SEQ ID NO: 44605 - RNA, 13 nt, Homo sapiens
gcgagcgcgcgcg

SEQ ID NO: 44606 - RNA, 14 nt, Homo sapiens
gcgagcgcgcgcgc

SEQ ID NO: 44607 - RNA, 15 nt, Homo sapiens
gcgagcgcgcgcgcc

SEQ ID NO: 44608 - RNA, 17 nt, Homo sapiens
gcgagcgcgcgcgcccu

SEQ ID NO: 44609 - RNA, 17 nt, Homo sapiens
gcgaguacuucccgcug

SEQ ID NO: 44610 - RNA, 18 nt, Homo sapiens
gcgaguacuucccgcugu

SEQ ID NO: 44611 - RNA, 19 nt, Homo sapiens
gcgaguacuucccgcuguu

SEQ ID NO: 44612 - RNA, 21 nt, Homo sapiens
gcgcaaucuuaacucauugca

SEQ ID NO: 44613 - RNA, 13 nt, Homo sapiens
gcgcagccaugug

SEQ ID NO: 44614 - RNA, 16 nt, Homo sapiens
gcgcagcucaggcugg

SEQ ID NO: 44615 - RNA, 12 nt, Homo sapiens
gcgccaccacgc

SEQ ID NO: 44616 - RNA, 13 nt, Homo sapiens
gcgccaccacgcc

SEQ ID NO: 44617 - RNA, 16 nt, Homo sapiens
gcgcccucuggcugcu

SEQ ID NO: 44618 - RNA, 18 nt, Homo sapiens
gcgcccucuggcugcugg

SEQ ID NO: 44619 - RNA, 19 nt, Homo sapiens
gcgcccucuggcugcuggu

SEQ ID NO: 44620 - RNA, 20 nt, Homo sapiens
gcgcccucuggcugcuggug

SEQ ID NO: 44621 - RNA, 12 nt, Homo sapiens
gcgccgcgcucc

SEQ ID NO: 44622 - RNA, 13 nt, Homo sapiens
gcgccgcgcuccu

SEQ ID NO: 44623 - RNA, 20 nt, Homo sapiens
gcgccgcgcuccucggacgg

SEQ ID NO: 44624 - RNA, 11 nt, Homo sapiens
gcgccuccgcu

SEQ ID NO: 44625 - RNA, 19 nt, Homo sapiens
gcgccuccgcuacuuccag

SEQ ID NO: 44626 - RNA, 20 nt, Homo sapiens
gcgccuccgcuacuuccagg

SEQ ID NO: 44627 - RNA, 22 nt, Homo sapiens
gcgccuccgcuacuuccagggc

SEQ ID NO: 44628 - RNA, 23 nt, Homo sapiens
gcgccuccgcuacuuccagggcu

SEQ ID NO: 44629 - RNA, 15 nt, Homo sapiens
gcgcgcaccuguaau

SEQ ID NO: 44630 - RNA, 16 nt, Homo sapiens
gcgcgcaccuguaauc

SEQ ID NO: 44631 - RNA, 12 nt, Homo sapiens
gcgcgccaccac

SEQ ID NO: 44632 - RNA, 14 nt, Homo sapiens
gcgcgccaccacgc

SEQ ID NO: 44633 - RNA, 16 nt, Homo sapiens
gcgcgccaccacgccc

SEQ ID NO: 44634 - RNA, 14 nt, Homo sapiens
gcgcgcccucuggc

SEQ ID NO: 44635 - RNA, 18 nt, Homo sapiens
gcgcgcccucuggcugcu

SEQ ID NO: 44636 - RNA, 21 nt, Homo sapiens
gcgcgcccucuggcugcuggu

SEQ ID NO: 44637 - RNA, 11 nt, Homo sapiens
gcgcgccgcgc

SEQ ID NO: 44638 - RNA, 13 nt, Homo sapiens
gcgcgccgcgcuc

SEQ ID NO: 44639 - RNA, 14 nt, Homo sapiens
gcgcgccgcgcucc

SEQ ID NO: 44640 - RNA, 13 nt, Homo sapiens
gcgcgccuccgcu

SEQ ID NO: 44641 - RNA, 14 nt, Homo sapiens
gcgcgccuccgcua

SEQ ID NO: 44642 - RNA, 20 nt, Homo sapiens
gcgcgccuccgcuacuucca

SEQ ID NO: 44643 - RNA, 11 nt, Homo sapiens
gcgcgcgccac

SEQ ID NO: 44644 - RNA, 12 nt, Homo sapiens
gcgcgcgccacc

SEQ ID NO: 44645 - RNA, 13 nt, Homo sapiens
gcgcgcgccacca

SEQ ID NO: 44646 - RNA, 14 nt, Homo sapiens
gcgcgcgccaccac

SEQ ID NO: 44647 - RNA, 15 nt, Homo sapiens
gcgcgcgccaccacg

SEQ ID NO: 44648 - RNA, 13 nt, Homo sapiens
gcgcgcgcccucu

SEQ ID NO: 44649 - RNA, 12 nt, Homo sapiens
gcgcgcgcgccc

SEQ ID NO: 44650 - RNA, 15 nt, Homo sapiens
gcgcgcucaucccac

SEQ ID NO: 44651 - RNA, 20 nt, Homo sapiens
gcgcgcucaucccacccgcc

SEQ ID NO: 44652 - RNA, 23 nt, Homo sapiens
gcgcgcucaucccacccgcccac

SEQ ID NO: 44653 - RNA, 11 nt, Homo sapiens
gcgcgcuccgc

SEQ ID NO: 44654 - RNA, 13 nt, Homo sapiens
gcgcgcuccgcgc

SEQ ID NO: 44655 - RNA, 14 nt, Homo sapiens
gcgcgcuccgcgca

SEQ ID NO: 44656 - RNA, 15 nt, Homo sapiens
gcgcgcuccgcgcag

SEQ ID NO: 44657 - RNA, 22 nt, Homo sapiens
gcgcgcuccgcgcagcucaggc

SEQ ID NO: 44658 - RNA, 23 nt, Homo sapiens
gcgcggcgggagggcgcggggcg

SEQ ID NO: 44659 - RNA, 12 nt, Homo sapiens
gcgcggggcggg

SEQ ID NO: 44660 - RNA, 15 nt, Homo sapiens
gcgcggggcggggag

SEQ ID NO: 44661 - RNA, 16 nt, Homo sapiens
gcgcggggcggggagc

SEQ ID NO: 44662 - RNA, 20 nt, Homo sapiens
gcgcggggcggggagcgagc

SEQ ID NO: 44663 - RNA, 21 nt, Homo sapiens
gcgcggggcggggagcgagcc

SEQ ID NO: 44664 - RNA, 12 nt, Homo sapiens
gcgcgugcaggc

SEQ ID NO: 44665 - RNA, 16 nt, Homo sapiens
gcgcgugcaggcagca

SEQ ID NO: 44666 - RNA, 16 nt, Homo sapiens
gcgcucaucccacccg

SEQ ID NO: 44667 - RNA, 20 nt, Homo sapiens
gcgcucaucccacccgccca

SEQ ID NO: 44668 - RNA, 12 nt, Homo sapiens
gcgcuccgcgca

SEQ ID NO: 44669 - RNA, 13 nt, Homo sapiens
gcgcuccgcgcag

SEQ ID NO: 44670 - RNA, 14 nt, Homo sapiens
gcgcuccgcgcagc

SEQ ID NO: 44671 - RNA, 15 nt, Homo sapiens
gcgcuccgcgcagcu

SEQ ID NO: 44672 - RNA, 20 nt, Homo sapiens
gcgcuccucggacggcuccg

SEQ ID NO: 44673 - RNA, 12 nt, Homo sapiens
gcgcucgcuucc

SEQ ID NO: 44674 - RNA, 13 nt, Homo sapiens
gcgcucgcuuccg

SEQ ID NO: 44675 - RNA, 14 nt, Homo sapiens
gcgcucgcuuccgc

SEQ ID NO: 44676 - RNA, 17 nt, Homo sapiens
gcgcucgcuuccgcauc

SEQ ID NO: 44677 - RNA, 18 nt, Homo sapiens
gcgcucgcuuccgcaucc

SEQ ID NO: 44678 - RNA, 19 nt, Homo sapiens
gcgcucgcuuccgcauccu

SEQ ID NO: 44679 - RNA, 13 nt, Homo sapiens
gcgcucggccugc

SEQ ID NO: 44680 - RNA, 14 nt, Homo sapiens
gcgcucggccugcu

SEQ ID NO: 44681 - RNA, 15 nt, Homo sapiens
gcgcucggccugcuc

SEQ ID NO: 44682 - RNA, 17 nt, Homo sapiens
gcgcucggccugcucgc

SEQ ID NO: 44683 - RNA, 18 nt, Homo sapiens
gcgcucggccugcucgcc

SEQ ID NO: 44684 - RNA, 19 nt, Homo sapiens
gcgcucggccugcucgccc

SEQ ID NO: 44685 - RNA, 21 nt, Homo sapiens
gcgcucggccugcucgcccac

SEQ ID NO: 44686 - RNA, 14 nt, Homo sapiens
gcgcugcgcgccgc

SEQ ID NO: 44687 - RNA, 16 nt, Homo sapiens
gcgcugcgcgccgcgc

SEQ ID NO: 44688 - RNA, 17 nt, Homo sapiens
gcgcugcgcgccgcgcu

SEQ ID NO: 44689 - RNA, 19 nt, Homo sapiens
gcgcugcgcgccgcgcucc

SEQ ID NO: 44690 - RNA, 22 nt, Homo sapiens
gcgcugcgcgccgcgcuccucg

SEQ ID NO: 44691 - RNA, 13 nt, Homo sapiens
gcgcuggcugcgc

SEQ ID NO: 44692 - RNA, 14 nt, Homo sapiens
gcgcuggcugcgcu

SEQ ID NO: 44693 - RNA, 23 nt, Homo sapiens
gcgcuggcugcgcucggccugcu

SEQ ID NO: 44694 - RNA, 12 nt, Homo sapiens
gcggaccuuccc

SEQ ID NO: 44695 - RNA, 13 nt, Homo sapiens
gcggaccuuccca

SEQ ID NO: 44696 - RNA, 14 nt, Homo sapiens
gcggaccuucccag

SEQ ID NO: 44697 - RNA, 15 nt, Homo sapiens
gcggaccuucccagc

SEQ ID NO: 44698 - RNA, 18 nt, Homo sapiens
gcggaccuucccagcuag

SEQ ID NO: 44699 - RNA, 17 nt, Homo sapiens
gcggauccaagcaaaug

SEQ ID NO: 44700 - RNA, 16 nt, Homo sapiens
gcggcccugugcggcc

SEQ ID NO: 44701 - RNA, 21 nt, Homo sapiens
gcggcccugugcggccugguc

SEQ ID NO: 44702 - RNA, 22 nt, Homo sapiens
gcggcccugugcggccuggucu

SEQ ID NO: 44703 - RNA, 13 nt, Homo sapiens
gcggccuggucua

SEQ ID NO: 44704 - RNA, 21 nt, Homo sapiens
gcggccuggucuaccuguucg

SEQ ID NO: 44705 - RNA, 17 nt, Homo sapiens
gcggcggcccugugcgg

SEQ ID NO: 44706 - RNA, 23 nt, Homo sapiens
gcggcggcccugugcggccuggu

SEQ ID NO: 44707 - RNA, 17 nt, Homo sapiens
gcggcgggagggcgcgg

SEQ ID NO: 44708 - RNA, 22 nt, Homo sapiens
gcgggacacaggcuccaaacug

SEQ ID NO: 44709 - RNA, 14 nt, Homo sapiens
gcggggagcgagcc

SEQ ID NO: 44710 - RNA, 21 nt, Homo sapiens
gcggggagcgagccccaggcg

SEQ ID NO: 44711 - RNA, 22 nt, Homo sapiens
gcggggagcgagccccaggcgg

SEQ ID NO: 44712 - RNA, 23 nt, Homo sapiens
gcggggagcgagccccaggcggg

SEQ ID NO: 44713 - RNA, 18 nt, Homo sapiens
gcgugaccugacagccca

SEQ ID NO: 44714 - RNA, 13 nt, Homo sapiens
gcgugagccacca

SEQ ID NO: 44715 - RNA, 15 nt, Homo sapiens
gcgugagccaccaaa

SEQ ID NO: 44716 - RNA, 19 nt, Homo sapiens
gcguuguggggaugaacuu

SEQ ID NO: 44717 - RNA, 17 nt, Homo sapiens
gcuaaauauauauuuua

SEQ ID NO: 44718 - RNA, 14 nt, Homo sapiens
gcuaagcauuccaa

SEQ ID NO: 44719 - RNA, 20 nt, Homo sapiens
gcuaagugaaauaagccaga

SEQ ID NO: 44720 - RNA, 12 nt, Homo sapiens
gcuacaggcccc

SEQ ID NO: 44721 - RNA, 14 nt, Homo sapiens
gcuacaggccccau

SEQ ID NO: 44722 - RNA, 18 nt, Homo sapiens
gcuacaggccccaucugg

SEQ ID NO: 44723 - RNA, 11 nt, Homo sapiens
gcuacgcgcgc

SEQ ID NO: 44724 - RNA, 12 nt, Homo sapiens
gcuacgcgcgcu

SEQ ID NO: 44725 - RNA, 16 nt, Homo sapiens
gcuacgcgcgcuccgc

SEQ ID NO: 44726 - RNA, 21 nt, Homo sapiens
gcuacgcgcgcuccgcgcagc

SEQ ID NO: 44727 - RNA, 14 nt, Homo sapiens
gcuacuuauuguag

SEQ ID NO: 44728 - RNA, 15 nt, Homo sapiens
gcuagaauuugauau

SEQ ID NO: 44729 - RNA, 12 nt, Homo sapiens
gcuaguuuauau

SEQ ID NO: 44730 - RNA, 13 nt, Homo sapiens
gcuauaggugcua

SEQ ID NO: 44731 - RNA, 13 nt, Homo sapiens
gcuaucaauccaa

SEQ ID NO: 44732 - RNA, 14 nt, Homo sapiens
gcuaucaauccaag

SEQ ID NO: 44733 - RNA, 21 nt, Homo sapiens
gcuaucgccaucacagcugaa

SEQ ID NO: 44734 - RNA, 14 nt, Homo sapiens
gcuaugcauuugaa

SEQ ID NO: 44735 - RNA, 13 nt, Homo sapiens
gcuaugcuauuga

SEQ ID NO: 44736 - RNA, 14 nt, Homo sapiens
gcuaugcuauugaa

SEQ ID NO: 44737 - RNA, 19 nt, Homo sapiens
gcuauuuauuaaguauuuu

SEQ ID NO: 44738 - RNA, 23 nt, Homo sapiens
gcucaacaagagacuggaaggac

SEQ ID NO: 44739 - RNA, 14 nt, Homo sapiens
gcucaacauaacau

SEQ ID NO: 44740 - RNA, 15 nt, Homo sapiens
gcucacgccuguaau

SEQ ID NO: 44741 - RNA, 16 nt, Homo sapiens
gcucacgccuguaauc

SEQ ID NO: 44742 - RNA, 14 nt, Homo sapiens
gcucaggcuggcac

SEQ ID NO: 44743 - RNA, 19 nt, Homo sapiens
gcucaggcuggcaccgcug

SEQ ID NO: 44744 - RNA, 20 nt, Homo sapiens
gcucaucccacccgcccacc

SEQ ID NO: 44745 - RNA, 21 nt, Homo sapiens
gcucaucccacccgcccaccg

SEQ ID NO: 44746 - RNA, 23 nt, Homo sapiens
gcucaucccacccgcccaccgca

SEQ ID NO: 44747 - RNA, 20 nt, Homo sapiens
gcucauggaauuggagcucg

SEQ ID NO: 44748 - RNA, 22 nt, Homo sapiens
gcucauggaauuggagcucgug

SEQ ID NO: 44749 - RNA, 15 nt, Homo sapiens
gcuccaaacuggagc

SEQ ID NO: 44750 - RNA, 14 nt, Homo sapiens
gcuccaagaauuuc

SEQ ID NO: 44751 - RNA, 13 nt, Homo sapiens
gcucccuggaaga

SEQ ID NO: 44752 - RNA, 18 nt, Homo sapiens
gcucccuggaagagauca

SEQ ID NO: 44753 - RNA, 15 nt, Homo sapiens
gcuccggacgcugcu

SEQ ID NO: 44754 - RNA, 21 nt, Homo sapiens
gcuccggacgcugcugccgug

SEQ ID NO: 44755 - RNA, 13 nt, Homo sapiens
gcuccucggacgg

SEQ ID NO: 44756 - RNA, 19 nt, Homo sapiens
gcuccucggacggcuccgg

SEQ ID NO: 44757 - RNA, 21 nt, Homo sapiens
gcuccucggacggcuccggac

SEQ ID NO: 44758 - RNA, 19 nt, Homo sapiens
gcuccugagacacaugggu

SEQ ID NO: 44759 - RNA, 14 nt, Homo sapiens
gcucgcccacuucc

SEQ ID NO: 44760 - RNA, 15 nt, Homo sapiens
gcucgcccacuuccu

SEQ ID NO: 44761 - RNA, 17 nt, Homo sapiens
gcucgcccacuuccucc

SEQ ID NO: 44762 - RNA, 21 nt, Homo sapiens
gcucgcccacuuccucccggc

SEQ ID NO: 44763 - RNA, 22 nt, Homo sapiens
gcucgcccacuuccucccggcc

SEQ ID NO: 44764 - RNA, 23 nt, Homo sapiens
gcucgcccacuuccucccggccg

SEQ ID NO: 44765 - RNA, 13 nt, Homo sapiens
gcucgcuuccgca

SEQ ID NO: 44766 - RNA, 15 nt, Homo sapiens
gcucgcuuccgcauc

SEQ ID NO: 44767 - RNA, 18 nt, Homo sapiens
gcucgcuuccgcauccua

SEQ ID NO: 44768 - RNA, 19 nt, Homo sapiens
gcucgcuuccgcauccuag

SEQ ID NO: 44769 - RNA, 20 nt, Homo sapiens
gcucgcuuccgcauccuagu

SEQ ID NO: 44770 - RNA, 21 nt, Homo sapiens
gcucgcuuccgcauccuaguc

SEQ ID NO: 44771 - RNA, 22 nt, Homo sapiens
gcucgcuuccgcauccuagucu

SEQ ID NO: 44772 - RNA, 15 nt, Homo sapiens
gcucggccugcucgc

SEQ ID NO: 44773 - RNA, 17 nt, Homo sapiens
gcucggccugcucgccc

SEQ ID NO: 44774 - RNA, 21 nt, Homo sapiens
gcucuaaaugucaaucagccu

SEQ ID NO: 44775 - RNA, 20 nt, Homo sapiens
gcucucaguugcagcccugc

SEQ ID NO: 44776 - RNA, 21 nt, Homo sapiens
gcucucaguugcagcccugcu

SEQ ID NO: 44777 - RNA, 14 nt, Homo sapiens
gcucucugaccucc

SEQ ID NO: 44778 - RNA, 16 nt, Homo sapiens
gcucugcauacucauu

SEQ ID NO: 44779 - RNA, 13 nt, Homo sapiens
gcucuggaaacca

SEQ ID NO: 44780 - RNA, 17 nt, Homo sapiens
gcucugggauagcugac

SEQ ID NO: 44781 - RNA, 15 nt, Homo sapiens
gcucugggucgccgg

SEQ ID NO: 44782 - RNA, 17 nt, Homo sapiens
gcucugggucgccggca

SEQ ID NO: 44783 - RNA, 19 nt, Homo sapiens
gcucugggucgccggcauc

SEQ ID NO: 44784 - RNA, 13 nt, Homo sapiens
gcugagcagaugu

SEQ ID NO: 44785 - RNA, 13 nt, Homo sapiens
gcugagcagucag

SEQ ID NO: 44786 - RNA, 16 nt, Homo sapiens
gcugaggcaagagaau

SEQ ID NO: 44787 - RNA, 13 nt, Homo sapiens
gcugaggcgggug

SEQ ID NO: 44788 - RNA, 19 nt, Homo sapiens
gcugauugucugaaauuuu

SEQ ID NO: 44789 - RNA, 13 nt, Homo sapiens
gcugcaccugugc

SEQ ID NO: 44790 - RNA, 15 nt, Homo sapiens
gcugcaccugugccg

SEQ ID NO: 44791 - RNA, 16 nt, Homo sapiens
gcugcaccugugccgu

SEQ ID NO: 44792 - RNA, 22 nt, Homo sapiens
gcugcagccccugggaccaggc

SEQ ID NO: 44793 - RNA, 13 nt, Homo sapiens
gcugcauuuaaaa

SEQ ID NO: 44794 - RNA, 15 nt, Homo sapiens
gcugccaauauccua

SEQ ID NO: 44795 - RNA, 15 nt, Homo sapiens
gcugccccggggagg

SEQ ID NO: 44796 - RNA, 20 nt, Homo sapiens
gcugccccggggaggggcgc

SEQ ID NO: 44797 - RNA, 23 nt, Homo sapiens
gcugccccggggaggggcgcucg

SEQ ID NO: 44798 - RNA, 24 nt, Homo sapiens
gcugccccggggaggggcgcucgc

SEQ ID NO: 44799 - RNA, 14 nt, Homo sapiens
gcugccgugggccu

SEQ ID NO: 44800 - RNA, 17 nt, Homo sapiens
gcugccuccccagcucu

SEQ ID NO: 44801 - RNA, 24 nt, Homo sapiens
gcugccuccccagcucuaucccaa

SEQ ID NO: 44802 - RNA, 13 nt, Homo sapiens
gcugcgcgccgcg

SEQ ID NO: 44803 - RNA, 17 nt, Homo sapiens
gcugcgcgccgcgcucc

SEQ ID NO: 44804 - RNA, 18 nt, Homo sapiens
gcugcgcgccgcgcuccu

SEQ ID NO: 44805 - RNA, 19 nt, Homo sapiens
gcugcgcgccgcgcuccuc

SEQ ID NO: 44806 - RNA, 13 nt, Homo sapiens
gcugcgcucggcc

SEQ ID NO: 44807 - RNA, 16 nt, Homo sapiens
gcugcgcucggccugc

SEQ ID NO: 44808 - RNA, 23 nt, Homo sapiens
gcugcgcucggccugcucgccca

SEQ ID NO: 44809 - RNA, 14 nt, Homo sapiens
gcugcugccguggg

SEQ ID NO: 44810 - RNA, 16 nt, Homo sapiens
gcugcugguggcgcug

SEQ ID NO: 44811 - RNA, 19 nt, Homo sapiens
gcugcugguggcgcuggcu

SEQ ID NO: 44812 - RNA, 22 nt, Homo sapiens
gcugcugguggcgcuggcugcg

SEQ ID NO: 44813 - RNA, 13 nt, Homo sapiens
gcuggagcucugc

SEQ ID NO: 44814 - RNA, 14 nt, Homo sapiens
gcuggagcucugcc

SEQ ID NO: 44815 - RNA, 12 nt, Homo sapiens
gcuggagugcag

SEQ ID NO: 44816 - RNA, 13 nt, Homo sapiens
gcuggagugcagu

SEQ ID NO: 44817 - RNA, 14 nt, Homo sapiens
gcuggagugcagug

SEQ ID NO: 44818 - RNA, 17 nt, Homo sapiens
gcuggagugcaguggcg

SEQ ID NO: 44819 - RNA, 23 nt, Homo sapiens
gcuggauguggagggggcgcgug

SEQ ID NO: 44820 - RNA, 19 nt, Homo sapiens
gcuggauucaagugauccg

SEQ ID NO: 44821 - RNA, 22 nt, Homo sapiens
gcuggauucaagugauccgccc

SEQ ID NO: 44822 - RNA, 19 nt, Homo sapiens
gcuggcaccgcuguacgcg

SEQ ID NO: 44823 - RNA, 17 nt, Homo sapiens
gcuggccaacgggguga

SEQ ID NO: 44824 - RNA, 17 nt, Homo sapiens
gcuggccaggcuggucu

SEQ ID NO: 44825 - RNA, 12 nt, Homo sapiens
gcuggcugcgcu

SEQ ID NO: 44826 - RNA, 15 nt, Homo sapiens
gcuggcugcgcucgg

SEQ ID NO: 44827 - RNA, 16 nt, Homo sapiens
gcuggcugcgcucggc

SEQ ID NO: 44828 - RNA, 17 nt, Homo sapiens
gcuggcugcgcucggcc

SEQ ID NO: 44829 - RNA, 18 nt, Homo sapiens
gcuggcugcgcucggccu

SEQ ID NO: 44830 - RNA, 19 nt, Homo sapiens
gcuggcugcgcucggccug

SEQ ID NO: 44831 - RNA, 20 nt, Homo sapiens
gcuggcugcgcucggccugc

SEQ ID NO: 44832 - RNA, 18 nt, Homo sapiens
gcuggcuugccucuugca

SEQ ID NO: 44833 - RNA, 22 nt, Homo sapiens
gcugggaauuacaggcgugagc

SEQ ID NO: 44834 - RNA, 15 nt, Homo sapiens
gcugggaguggcaug

SEQ ID NO: 44835 - RNA, 16 nt, Homo sapiens
gcugggaguggcaugu

SEQ ID NO: 44836 - RNA, 18 nt, Homo sapiens
gcuggucucgaacugcug

SEQ ID NO: 44837 - RNA, 20 nt, Homo sapiens
gcuggucucgaacugcugga

SEQ ID NO: 44838 - RNA, 12 nt, Homo sapiens
gcugguggcgcu

SEQ ID NO: 44839 - RNA, 13 nt, Homo sapiens
gcugguggcgcug

SEQ ID NO: 44840 - RNA, 14 nt, Homo sapiens
gcugguggcgcugg

SEQ ID NO: 44841 - RNA, 18 nt, Homo sapiens
gcugguggcgcuggcugc

SEQ ID NO: 44842 - RNA, 22 nt, Homo sapiens
gcugguggcgcuggcugcgcuc

SEQ ID NO: 44843 - RNA, 15 nt, Homo sapiens
gcuguacgcgagcgc

SEQ ID NO: 44844 - RNA, 16 nt, Homo sapiens
gcuguacgcgagcgcg

SEQ ID NO: 44845 - RNA, 17 nt, Homo sapiens
gcuguacgcgagcgcgc

SEQ ID NO: 44846 - RNA, 19 nt, Homo sapiens
gcuguacgcgagcgcgcgc

SEQ ID NO: 44847 - RNA, 21 nt, Homo sapiens
gcuguacgcgagcgcgcgcgc

SEQ ID NO: 44848 - RNA, 19 nt, Homo sapiens
gcuguaugauucccagcca

SEQ ID NO: 44849 - RNA, 13 nt, Homo sapiens
gcuguauucuucu

SEQ ID NO: 44850 - RNA, 20 nt, Homo sapiens
gcugucuauguggcuguauc

SEQ ID NO: 44851 - RNA, 23 nt, Homo sapiens
gcuguucacagccagacuggcac

SEQ ID NO: 44852 - RNA, 13 nt, Homo sapiens
gcuguuccucgcc

SEQ ID NO: 44853 - RNA, 16 nt, Homo sapiens
gcuguuccucgccacg

SEQ ID NO: 44854 - RNA, 17 nt, Homo sapiens
gcuguuccucgccacgc

SEQ ID NO: 44855 - RNA, 18 nt, Homo sapiens
gcuguuccucgccacgcu

SEQ ID NO: 44856 - RNA, 14 nt, Homo sapiens
gcuguuuucccuga

SEQ ID NO: 44857 - RNA, 15 nt, Homo sapiens
gcuuaaaauguaauu

SEQ ID NO: 44858 - RNA, 21 nt, Homo sapiens
gcuuaauuauugauguuuuca

SEQ ID NO: 44859 - RNA, 14 nt, Homo sapiens
gcuuagaacaaagg

SEQ ID NO: 44860 - RNA, 12 nt, Homo sapiens
gcuuagacccuc

SEQ ID NO: 44861 - RNA, 13 nt, Homo sapiens
gcuuagacccuca

SEQ ID NO: 44862 - RNA, 20 nt, Homo sapiens
gcuuagacccucaugcugcc

SEQ ID NO: 44863 - RNA, 21 nt, Homo sapiens
gcuuauucacaagacccaaaa

SEQ ID NO: 44864 - RNA, 16 nt, Homo sapiens
gcuuauugguggcugu

SEQ ID NO: 44865 - RNA, 17 nt, Homo sapiens
gcuucaccuguccccga

SEQ ID NO: 44866 - RNA, 18 nt, Homo sapiens
gcuuccauuccaagccug

SEQ ID NO: 44867 - RNA, 11 nt, Homo sapiens
gcuuccgcauc

SEQ ID NO: 44868 - RNA, 14 nt, Homo sapiens
gcuuccgcauccua

SEQ ID NO: 44869 - RNA, 18 nt, Homo sapiens
gcuuccgcauccuagucu

SEQ ID NO: 44870 - RNA, 20 nt, Homo sapiens
gcuucuauuagcccuucucc

SEQ ID NO: 44871 - RNA, 22 nt, Homo sapiens
gcuugaggacuugggcgggaca

SEQ ID NO: 44872 - RNA, 13 nt, Homo sapiens
gcuuggcccagga

SEQ ID NO: 44873 - RNA, 14 nt, Homo sapiens
gcuuggcccaggag

SEQ ID NO: 44874 - RNA, 15 nt, Homo sapiens
gcuuggcccaggagu

SEQ ID NO: 44875 - RNA, 21 nt, Homo sapiens
gcuuggcccaggaguuuggcc

SEQ ID NO: 44876 - RNA, 15 nt, Homo sapiens
gcuugugugcacaua

SEQ ID NO: 44877 - RNA, 19 nt, Homo sapiens
gcuuguuagcaaaauggau

SEQ ID NO: 44878 - RNA, 19 nt, Homo sapiens
gcuuuaaaacuuauccucc

SEQ ID NO: 44879 - RNA, 13 nt, Homo sapiens
gcuuuaauuucau

SEQ ID NO: 44880 - RNA, 16 nt, Homo sapiens
gcuuuaauuucaugaa

SEQ ID NO: 44881 - RNA, 16 nt, Homo sapiens
gcuuuagggaccugcu

SEQ ID NO: 44882 - RNA, 19 nt, Homo sapiens
gcuuuugcuaggucacaga

SEQ ID NO: 44883 - RNA, 14 nt, Homo sapiens
gcuuuugugcauua

SEQ ID NO: 44884 - RNA, 15 nt, Homo sapiens
ggaaaaugugcaaua

SEQ ID NO: 44885 - RNA, 22 nt, Homo sapiens
ggaaaaugugcaauaugugaug

SEQ ID NO: 44886 - RNA, 12 nt, Homo sapiens
ggaaacaaguca

SEQ ID NO: 44887 - RNA, 18 nt, Homo sapiens
ggaaacaagucagucauu

SEQ ID NO: 44888 - RNA, 15 nt, Homo sapiens
ggaaacguauucaaa

SEQ ID NO: 44889 - RNA, 18 nt, Homo sapiens
ggaaagaagagccggagc

SEQ ID NO: 44890 - RNA, 20 nt, Homo sapiens
ggaaagaagagccggagccu

SEQ ID NO: 44891 - RNA, 13 nt, Homo sapiens
ggaaaggcagcuc

SEQ ID NO: 44892 - RNA, 16 nt, Homo sapiens
ggaaagggucucccuc

SEQ ID NO: 44893 - RNA, 11 nt, Homo sapiens
ggaaauauuuu

SEQ ID NO: 44894 - RNA, 19 nt, Homo sapiens
ggaaauauuuuaauguuuc

SEQ ID NO: 44895 - RNA, 15 nt, Homo sapiens
ggaaaugauguuuca

SEQ ID NO: 44896 - RNA, 15 nt, Homo sapiens
ggaacauaaaauaca

SEQ ID NO: 44897 - RNA, 13 nt, Homo sapiens
ggaacugcuugac

SEQ ID NO: 44898 - RNA, 17 nt, Homo sapiens
ggaagaaauuccaggaa

SEQ ID NO: 44899 - RNA, 21 nt, Homo sapiens
ggaagccaaaccucugugagc

SEQ ID NO: 44900 - RNA, 16 nt, Homo sapiens
ggaaggcaacauacac

SEQ ID NO: 44901 - RNA, 15 nt, Homo sapiens
ggaagguauuuaaua

SEQ ID NO: 44902 - RNA, 19 nt, Homo sapiens
ggaagguucuggugugaac

SEQ ID NO: 44903 - RNA, 23 nt, Homo sapiens
ggaauauguuagagaauuuccuu

SEQ ID NO: 44904 - RNA, 20 nt, Homo sapiens
ggaauauuugcaagacauag

SEQ ID NO: 44905 - RNA, 18 nt, Homo sapiens
ggaaucacuggcuguuaa

SEQ ID NO: 44906 - RNA, 19 nt, Homo sapiens
ggaaugaagauacugaaau

SEQ ID NO: 44907 - RNA, 17 nt, Homo sapiens
ggaauguaugugcacau

SEQ ID NO: 44908 - RNA, 12 nt, Homo sapiens
ggaauugaccca

SEQ ID NO: 44909 - RNA, 14 nt, Homo sapiens
ggaauuggagcucg

SEQ ID NO: 44910 - RNA, 15 nt, Homo sapiens
ggaauuggagcucgu

SEQ ID NO: 44911 - RNA, 18 nt, Homo sapiens
ggaauuggagcucguggg

SEQ ID NO: 44912 - RNA, 22 nt, Homo sapiens
ggacagcccuucuuuccacaga

SEQ ID NO: 44913 - RNA, 18 nt, Homo sapiens
ggacaggauaagagggau

SEQ ID NO: 44914 - RNA, 16 nt, Homo sapiens
ggacaugggccccaga

SEQ ID NO: 44915 - RNA, 16 nt, Homo sapiens
ggacauuugcucaugg

SEQ ID NO: 44916 - RNA, 18 nt, Homo sapiens
ggacauuugcucauggaa

SEQ ID NO: 44917 - RNA, 19 nt, Homo sapiens
ggacauuugcucauggaau

SEQ ID NO: 44918 - RNA, 18 nt, Homo sapiens
ggaccaggcacccccaga

SEQ ID NO: 44919 - RNA, 13 nt, Homo sapiens
ggaccaucccggc

SEQ ID NO: 44920 - RNA, 16 nt, Homo sapiens
ggaccaucccggccgg

SEQ ID NO: 44921 - RNA, 17 nt, Homo sapiens
ggaccaucccggccggc

SEQ ID NO: 44922 - RNA, 20 nt, Homo sapiens
ggaccaucccggccggcgcg

SEQ ID NO: 44923 - RNA, 21 nt, Homo sapiens
ggaccaucccggccggcgcgc

SEQ ID NO: 44924 - RNA, 23 nt, Homo sapiens
ggaccaucccggccggcgcgcuc

SEQ ID NO: 44925 - RNA, 10 nt, Homo sapiens
ggaccugcug

SEQ ID NO: 44926 - RNA, 18 nt, Homo sapiens
ggaccugggccauaguca

SEQ ID NO: 44927 - RNA, 14 nt, Homo sapiens
ggacgaaccuugaa

SEQ ID NO: 44928 - RNA, 11 nt, Homo sapiens
ggacgcugcug

SEQ ID NO: 44929 - RNA, 15 nt, Homo sapiens
ggacgcugcugccgu

SEQ ID NO: 44930 - RNA, 12 nt, Homo sapiens
ggacggcuccgg

SEQ ID NO: 44931 - RNA, 13 nt, Homo sapiens
ggacggcuccgga

SEQ ID NO: 44932 - RNA, 19 nt, Homo sapiens
ggacggcuccggacgcugc

SEQ ID NO: 44933 - RNA, 21 nt, Homo sapiens
ggacggcuccggacgcugcug

SEQ ID NO: 44934 - RNA, 16 nt, Homo sapiens
ggacuuacuauuuauu

SEQ ID NO: 44935 - RNA, 13 nt, Homo sapiens
ggacuugaaccca

SEQ ID NO: 44936 - RNA, 13 nt, Homo sapiens
ggacuugggcggg

SEQ ID NO: 44937 - RNA, 15 nt, Homo sapiens
ggacuugggcgggac

SEQ ID NO: 44938 - RNA, 18 nt, Homo sapiens
ggacuugggcgggacaca

SEQ ID NO: 44939 - RNA, 19 nt, Homo sapiens
ggacuugggcgggacacag

SEQ ID NO: 44940 - RNA, 19 nt, Homo sapiens
ggagaaaggacccucaaga

SEQ ID NO: 44941 - RNA, 17 nt, Homo sapiens
ggagaagagcuguucac

SEQ ID NO: 44942 - RNA, 18 nt, Homo sapiens
ggagaagagcuguucaca

SEQ ID NO: 44943 - RNA, 11 nt, Homo sapiens
ggagacaccac

SEQ ID NO: 44944 - RNA, 12 nt, Homo sapiens
ggagacaccacc

SEQ ID NO: 44945 - RNA, 13 nt, Homo sapiens
ggagacaccacca

SEQ ID NO: 44946 - RNA, 17 nt, Homo sapiens
ggagauuuacaacuggg

SEQ ID NO: 44947 - RNA, 18 nt, Homo sapiens
ggagccaacagaagcuuc

SEQ ID NO: 44948 - RNA, 12 nt, Homo sapiens
ggagccccaauu

SEQ ID NO: 44949 - RNA, 19 nt, Homo sapiens
ggagccgggaaagaagagc

SEQ ID NO: 44950 - RNA, 12 nt, Homo sapiens
ggagccuccagc

SEQ ID NO: 44951 - RNA, 14 nt, Homo sapiens
ggagccuccagcug

SEQ ID NO: 44952 - RNA, 15 nt, Homo sapiens
ggagccuccagcugc

SEQ ID NO: 44953 - RNA, 17 nt, Homo sapiens
ggagccuccagcugccc

SEQ ID NO: 44954 - RNA, 19 nt, Homo sapiens
ggagccuccagcugccccg

SEQ ID NO: 44955 - RNA, 14 nt, Homo sapiens
ggagccugcaacau

SEQ ID NO: 44956 - RNA, 16 nt, Homo sapiens
ggagcgagccccaggc

SEQ ID NO: 44957 - RNA, 17 nt, Homo sapiens
ggagcgagccccaggcg

SEQ ID NO: 44958 - RNA, 18 nt, Homo sapiens
ggagcgagccccaggcgg

SEQ ID NO: 44959 - RNA, 22 nt, Homo sapiens
ggagcgagccccaggcgggucc

SEQ ID NO: 44960 - RNA, 10 nt, Homo sapiens
ggagcucgug

SEQ ID NO: 44961 - RNA, 11 nt, Homo sapiens
ggagcucgugg

SEQ ID NO: 44962 - RNA, 15 nt, Homo sapiens
ggagcucguggaaca

SEQ ID NO: 44963 - RNA, 17 nt, Homo sapiens
ggagcucgugggacagu

SEQ ID NO: 44964 - RNA, 19 nt, Homo sapiens
ggagcucugcccauccugc

SEQ ID NO: 44965 - RNA, 20 nt, Homo sapiens
ggagcucugcccauccugcc

SEQ ID NO: 44966 - RNA, 11 nt, Homo sapiens
ggagcugccuc

SEQ ID NO: 44967 - RNA, 18 nt, Homo sapiens
ggaggaaaaggugucuug

SEQ ID NO: 44968 - RNA, 16 nt, Homo sapiens
ggaggcugaggcgggu

SEQ ID NO: 44969 - RNA, 22 nt, Homo sapiens
ggagggaagccuuggggcugau

SEQ ID NO: 44970 - RNA, 12 nt, Homo sapiens
ggagggcgcggg

SEQ ID NO: 44971 - RNA, 14 nt, Homo sapiens
ggagggcgcggggc

SEQ ID NO: 44972 - RNA, 15 nt, Homo sapiens
ggagggcgcggggcg

SEQ ID NO: 44973 - RNA, 14 nt, Homo sapiens
ggaggggcgcucgc

SEQ ID NO: 44974 - RNA, 18 nt, Homo sapiens
ggagggggcgcgugcagg

SEQ ID NO: 44975 - RNA, 16 nt, Homo sapiens
ggaguggcauguauga

SEQ ID NO: 44976 - RNA, 16 nt, Homo sapiens
ggaguggcgcgcgcca

SEQ ID NO: 44977 - RNA, 21 nt, Homo sapiens
ggaguuaggcuauucacaacc

SEQ ID NO: 44978 - RNA, 21 nt, Homo sapiens
ggaguuccuaaccagccuggu

SEQ ID NO: 44979 - RNA, 13 nt, Homo sapiens
ggaguuuggccag

SEQ ID NO: 44980 - RNA, 14 nt, Homo sapiens
ggaguuuggccaga

SEQ ID NO: 44981 - RNA, 15 nt, Homo sapiens
ggauagagugggaca

SEQ ID NO: 44982 - RNA, 13 nt, Homo sapiens
ggaugauguuucg

SEQ ID NO: 44983 - RNA, 13 nt, Homo sapiens
ggaugcccacggc

SEQ ID NO: 44984 - RNA, 20 nt, Homo sapiens
ggauucaagugauccgccca

SEQ ID NO: 44985 - RNA, 15 nt, Homo sapiens
ggauucaauuuuaag

SEQ ID NO: 44986 - RNA, 15 nt, Homo sapiens
ggauuccucacuuug

SEQ ID NO: 44987 - RNA, 16 nt, Homo sapiens
ggauuccucacuuuga

SEQ ID NO: 44988 - RNA, 14 nt, Homo sapiens
ggauuugcaacccc

SEQ ID NO: 44989 - RNA, 19 nt, Homo sapiens
ggcaaacugccaucauuua

SEQ ID NO: 44990 - RNA, 14 nt, Homo sapiens
ggcacaggguuuau

SEQ ID NO: 44991 - RNA, 22 nt, Homo sapiens
ggcacccccagaaugaccuggc

SEQ ID NO: 44992 - RNA, 11 nt, Homo sapiens
ggcaccgcugu

SEQ ID NO: 44993 - RNA, 20 nt, Homo sapiens
ggcaccgcuguacgcgagcg

SEQ ID NO: 44994 - RNA, 13 nt, Homo sapiens
ggcacuugggaca

SEQ ID NO: 44995 - RNA, 19 nt, Homo sapiens
ggcacuugggacaaaaaca

SEQ ID NO: 44996 - RNA, 20 nt, Homo sapiens
ggcacuugggacaaaaacaa

SEQ ID NO: 44997 - RNA, 21 nt, Homo sapiens
ggcacuugggacaaaaacaaa

SEQ ID NO: 44998 - RNA, 13 nt, Homo sapiens
ggcagaagcaacc

SEQ ID NO: 44999 - RNA, 14 nt, Homo sapiens
ggcagaagcaaccc

SEQ ID NO: 45000 - RNA, 15 nt, Homo sapiens
ggcagcaggauagag

SEQ ID NO: 45001 - RNA, 22 nt, Homo sapiens
ggcagcaggauagagugggaca

SEQ ID NO: 45002 - RNA, 17 nt, Homo sapiens
ggcagggacaggauaag

SEQ ID NO: 45003 - RNA, 17 nt, Homo sapiens
ggcaggucacacaaccu

SEQ ID NO: 45004 - RNA, 13 nt, Homo sapiens
ggcagugcuuggc

SEQ ID NO: 45005 - RNA, 20 nt, Homo sapiens
ggcagugcuuggcccaggag

SEQ ID NO: 45006 - RNA, 21 nt, Homo sapiens
ggcaguuuuccauugguuuac

SEQ ID NO: 45007 - RNA, 19 nt, Homo sapiens
ggcaugguggcgcgcaccu

SEQ ID NO: 45008 - RNA, 21 nt, Homo sapiens
ggcauguaugacgugacuggc

SEQ ID NO: 45009 - RNA, 22 nt, Homo sapiens
ggcauguaugacgugacuggcc

SEQ ID NO: 45010 - RNA, 14 nt, Homo sapiens
ggcauucucugaag

SEQ ID NO: 45011 - RNA, 16 nt, Homo sapiens
ggcauuuucacuuuug

SEQ ID NO: 45012 - RNA, 14 nt, Homo sapiens
ggccaacuaggcag

SEQ ID NO: 45013 - RNA, 14 nt, Homo sapiens
ggccagaagucaag

SEQ ID NO: 45014 - RNA, 22 nt, Homo sapiens
ggccagaagucaaggcuuagac

SEQ ID NO: 45015 - RNA, 21 nt, Homo sapiens
ggcccaggaguuuggccagaa

SEQ ID NO: 45016 - RNA, 21 nt, Homo sapiens
ggccccagauaccaugaugcu

SEQ ID NO: 45017 - RNA, 16 nt, Homo sapiens
ggcccccgggccgacg

SEQ ID NO: 45018 - RNA, 13 nt, Homo sapiens
ggcccugccaugc

SEQ ID NO: 45019 - RNA, 14 nt, Homo sapiens
ggcccugccaugcu

SEQ ID NO: 45020 - RNA, 20 nt, Homo sapiens
ggcccugccaugcucuccaa

SEQ ID NO: 45021 - RNA, 23 nt, Homo sapiens
ggcccuggccuagcauacguaca

SEQ ID NO: 45022 - RNA, 11 nt, Homo sapiens
ggcccugugcg

SEQ ID NO: 45023 - RNA, 12 nt, Homo sapiens
ggcccugugcgg

SEQ ID NO: 45024 - RNA, 16 nt, Homo sapiens
ggcccugugcggccug

SEQ ID NO: 45025 - RNA, 17 nt, Homo sapiens
ggcccugugcggccugg

SEQ ID NO: 45026 - RNA, 18 nt, Homo sapiens
ggcccugugcggccuggu

SEQ ID NO: 45027 - RNA, 19 nt, Homo sapiens
ggcccugugcggccugguc

SEQ ID NO: 45028 - RNA, 12 nt, Homo sapiens
ggccgacggagc

SEQ ID NO: 45029 - RNA, 14 nt, Homo sapiens
ggccgacggagccg

SEQ ID NO: 45030 - RNA, 17 nt, Homo sapiens
ggccgacggagccggga

SEQ ID NO: 45031 - RNA, 14 nt, Homo sapiens
ggccgcgcugcgcg

SEQ ID NO: 45032 - RNA, 15 nt, Homo sapiens
ggccgcgcugcgcgc

SEQ ID NO: 45033 - RNA, 17 nt, Homo sapiens
ggccgcgcugcgcgccg

SEQ ID NO: 45034 - RNA, 20 nt, Homo sapiens
ggccgcgcugcgcgccgcgc

SEQ ID NO: 45035 - RNA, 21 nt, Homo sapiens
ggccgcgcugcgcgccgcgcu

SEQ ID NO: 45036 - RNA, 11 nt, Homo sapiens
ggccggcgcgc

SEQ ID NO: 45037 - RNA, 12 nt, Homo sapiens
ggccggcgcgcu

SEQ ID NO: 45038 - RNA, 16 nt, Homo sapiens
ggccggcgcgcucauc

SEQ ID NO: 45039 - RNA, 13 nt, Homo sapiens
ggccuccucucuc

SEQ ID NO: 45040 - RNA, 23 nt, Homo sapiens
ggccugagaccaaggcccccggg

SEQ ID NO: 45041 - RNA, 14 nt, Homo sapiens
ggccugcucgccca

SEQ ID NO: 45042 - RNA, 15 nt, Homo sapiens
ggccugcucgcccac

SEQ ID NO: 45043 - RNA, 20 nt, Homo sapiens
ggccugcucgcccacuuccu

SEQ ID NO: 45044 - RNA, 21 nt, Homo sapiens
ggccugcucgcccacuuccuc

SEQ ID NO: 45045 - RNA, 10 nt, Homo sapiens
ggccugcugg

SEQ ID NO: 45046 - RNA, 11 nt, Homo sapiens
ggccugcugga

SEQ ID NO: 45047 - RNA, 14 nt, Homo sapiens
ggccugcuggaugu

SEQ ID NO: 45048 - RNA, 15 nt, Homo sapiens
ggccugcuggaugug

SEQ ID NO: 45049 - RNA, 12 nt, Homo sapiens
ggccuggcuggg

SEQ ID NO: 45050 - RNA, 19 nt, Homo sapiens
ggccuggucuaccuguucg

SEQ ID NO: 45051 - RNA, 21 nt, Homo sapiens
ggccuggucuaccuguucgcg

SEQ ID NO: 45052 - RNA, 21 nt, Homo sapiens
ggccuguugaagaugcuugua

SEQ ID NO: 45053 - RNA, 20 nt, Homo sapiens
ggcgacaguuuuccuucuca

SEQ ID NO: 45054 - RNA, 12 nt, Homo sapiens
ggcgcgcaccug

SEQ ID NO: 45055 - RNA, 21 nt, Homo sapiens
ggcgcgcaccuguaaucccag

SEQ ID NO: 45056 - RNA, 15 nt, Homo sapiens
ggcgcgcgccaccac

SEQ ID NO: 45057 - RNA, 17 nt, Homo sapiens
ggcgcgcgccaccacgc

SEQ ID NO: 45058 - RNA, 18 nt, Homo sapiens
ggcgcgcgccaccacgcc

SEQ ID NO: 45059 - RNA, 19 nt, Homo sapiens
ggcgcgcgccaccacgccc

SEQ ID NO: 45060 - RNA, 20 nt, Homo sapiens
ggcgcgcgccaccacgccca

SEQ ID NO: 45061 - RNA, 21 nt, Homo sapiens
ggcgcgcgccaccacgcccag

SEQ ID NO: 45062 - RNA, 22 nt, Homo sapiens
ggcgcgcucaucccacccgccc

SEQ ID NO: 45063 - RNA, 21 nt, Homo sapiens
ggcgcggcgggagggcgcggg

SEQ ID NO: 45064 - RNA, 15 nt, Homo sapiens
ggcgcggggcgggga

SEQ ID NO: 45065 - RNA, 22 nt, Homo sapiens
ggcgcggggcggggagcgagcc

SEQ ID NO: 45066 - RNA, 23 nt, Homo sapiens
ggcgcggggcggggagcgagccc

SEQ ID NO: 45067 - RNA, 17 nt, Homo sapiens
ggcgcgugcaggcagca

SEQ ID NO: 45068 - RNA, 20 nt, Homo sapiens
ggcgcgugcaggcagcagga

SEQ ID NO: 45069 - RNA, 14 nt, Homo sapiens
ggcgcucgcuuccg

SEQ ID NO: 45070 - RNA, 16 nt, Homo sapiens
ggcgcucgcuuccgca

SEQ ID NO: 45071 - RNA, 14 nt, Homo sapiens
ggcgcuggcugcgc

SEQ ID NO: 45072 - RNA, 20 nt, Homo sapiens
ggcgcuggcugcgcucggcc

SEQ ID NO: 45073 - RNA, 22 nt, Homo sapiens
ggcgcuggcugcgcucggccug

SEQ ID NO: 45074 - RNA, 23 nt, Homo sapiens
ggcgcuggcugcgcucggccugc

SEQ ID NO: 45075 - RNA, 13 nt, Homo sapiens
ggcggcccugugc

SEQ ID NO: 45076 - RNA, 16 nt, Homo sapiens
ggcggcccugugcggc

SEQ ID NO: 45077 - RNA, 19 nt, Homo sapiens
ggcggcccugugcggccug

SEQ ID NO: 45078 - RNA, 20 nt, Homo sapiens
ggcggcccugugcggccugg

SEQ ID NO: 45079 - RNA, 13 nt, Homo sapiens
ggcggcggcccug

SEQ ID NO: 45080 - RNA, 23 nt, Homo sapiens
ggcgggacacaggcuccaaacug

SEQ ID NO: 45081 - RNA, 13 nt, Homo sapiens
ggcggggagcgag

SEQ ID NO: 45082 - RNA, 11 nt, Homo sapiens
ggcggguccgg

SEQ ID NO: 45083 - RNA, 14 nt, Homo sapiens
ggcggguccggguc

SEQ ID NO: 45084 - RNA, 18 nt, Homo sapiens
ggcggguggaucacuuga

SEQ ID NO: 45085 - RNA, 19 nt, Homo sapiens
ggcgugaccugacagccca

SEQ ID NO: 45086 - RNA, 21 nt, Homo sapiens
ggcgugaccugacagcccaag

SEQ ID NO: 45087 - RNA, 19 nt, Homo sapiens
ggcuaagcaaaaugugaua

SEQ ID NO: 45088 - RNA, 15 nt, Homo sapiens
ggcuacgcgcgcucc

SEQ ID NO: 45089 - RNA, 17 nt, Homo sapiens
ggcuacgcgcgcuccgc

SEQ ID NO: 45090 - RNA, 20 nt, Homo sapiens
ggcuacgcgcgcuccgcgca

SEQ ID NO: 45091 - RNA, 21 nt, Homo sapiens
ggcuacgcgcgcuccgcgcag

SEQ ID NO: 45092 - RNA, 13 nt, Homo sapiens
ggcuauucacaac

SEQ ID NO: 45093 - RNA, 14 nt, Homo sapiens
ggcuauucacaacc

SEQ ID NO: 45094 - RNA, 22 nt, Homo sapiens
ggcuauucacaaccacucauuc

SEQ ID NO: 45095 - RNA, 16 nt, Homo sapiens
ggcuauuuaaagacaa

SEQ ID NO: 45096 - RNA, 20 nt, Homo sapiens
ggcucacgccuguaauccca

SEQ ID NO: 45097 - RNA, 13 nt, Homo sapiens
ggcuccaaacugg

SEQ ID NO: 45098 - RNA, 17 nt, Homo sapiens
ggcuccaaacuggagcu

SEQ ID NO: 45099 - RNA, 16 nt, Homo sapiens
ggcuccggacgcugcu

SEQ ID NO: 45100 - RNA, 18 nt, Homo sapiens
ggcuccggacgcugcugc

SEQ ID NO: 45101 - RNA, 20 nt, Homo sapiens
ggcuccggacgcugcugccg

SEQ ID NO: 45102 - RNA, 16 nt, Homo sapiens
ggcuccugagacacau

SEQ ID NO: 45103 - RNA, 13 nt, Homo sapiens
ggcugagcaguca

SEQ ID NO: 45104 - RNA, 15 nt, Homo sapiens
ggcugaggcgggugg

SEQ ID NO: 45105 - RNA, 12 nt, Homo sapiens
ggcugcgcucgg

SEQ ID NO: 45106 - RNA, 16 nt, Homo sapiens
ggcugcgcucggccug

SEQ ID NO: 45107 - RNA, 19 nt, Homo sapiens
ggcugcgcucggccugcuc

SEQ ID NO: 45108 - RNA, 22 nt, Homo sapiens
ggcugcgcucggccugcucgcc

SEQ ID NO: 45109 - RNA, 13 nt, Homo sapiens
ggcugcugguggc

SEQ ID NO: 45110 - RNA, 14 nt, Homo sapiens
ggcugcugguggcg

SEQ ID NO: 45111 - RNA, 16 nt, Homo sapiens
ggcugcugguggcgcu

SEQ ID NO: 45112 - RNA, 17 nt, Homo sapiens
ggcugcugguggcgcug

SEQ ID NO: 45113 - RNA, 16 nt, Homo sapiens
ggcuggagcugccucu

SEQ ID NO: 45114 - RNA, 21 nt, Homo sapiens
ggcuggagcugccucucucau

SEQ ID NO: 45115 - RNA, 12 nt, Homo sapiens
ggcuggagugca

SEQ ID NO: 45116 - RNA, 14 nt, Homo sapiens
ggcuggagugcagu

SEQ ID NO: 45117 - RNA, 15 nt, Homo sapiens
ggcuggagugcagug

SEQ ID NO: 45118 - RNA, 20 nt, Homo sapiens
ggcuggagugcaguggcgca

SEQ ID NO: 45119 - RNA, 16 nt, Homo sapiens
ggcuggcaccgcugua

SEQ ID NO: 45120 - RNA, 21 nt, Homo sapiens
ggcuggucucgaacugcugga

SEQ ID NO: 45121 - RNA, 16 nt, Homo sapiens
ggcuuagacccucaug

SEQ ID NO: 45122 - RNA, 17 nt, Homo sapiens
ggcuuagacccucaugc

SEQ ID NO: 45123 - RNA, 21 nt, Homo sapiens
ggcuuagacccucaugcugcc

SEQ ID NO: 45124 - RNA, 24 nt, Homo sapiens
ggcuuuaaaacuuauccuccauga

SEQ ID NO: 45125 - RNA, 17 nt, Homo sapiens
ggcuuuagggaccugcu

SEQ ID NO: 45126 - RNA, 14 nt, Homo sapiens
ggcuuuuauugcca

SEQ ID NO: 45127 - RNA, 11 nt, Homo sapiens
gggaaacugcc

SEQ ID NO: 45128 - RNA, 16 nt, Homo sapiens
gggaaagaagagccgg

SEQ ID NO: 45129 - RNA, 17 nt, Homo sapiens
gggaaagaagagccgga

SEQ ID NO: 45130 - RNA, 14 nt, Homo sapiens
gggaaagggcuguu

SEQ ID NO: 45131 - RNA, 21 nt, Homo sapiens
gggaaauccacacugagcuga

SEQ ID NO: 45132 - RNA, 20 nt, Homo sapiens
gggaaugaagauacugaaau

SEQ ID NO: 45133 - RNA, 19 nt, Homo sapiens
gggacagucaccucaugga

SEQ ID NO: 45134 - RNA, 18 nt, Homo sapiens
gggacauuugcucaugga

SEQ ID NO: 45135 - RNA, 16 nt, Homo sapiens
gggaccucuccaugau

SEQ ID NO: 45136 - RNA, 14 nt, Homo sapiens
gggaccugcuguuu

SEQ ID NO: 45137 - RNA, 11 nt, Homo sapiens
gggaccugggc

SEQ ID NO: 45138 - RNA, 20 nt, Homo sapiens
gggagcuuuuguagaaguca

SEQ ID NO: 45139 - RNA, 20 nt, Homo sapiens
gggaggcagagguugcagug

SEQ ID NO: 45140 - RNA, 14 nt, Homo sapiens
gggaggggcgcucg

SEQ ID NO: 45141 - RNA, 15 nt, Homo sapiens
gggaggggcgcucgc

SEQ ID NO: 45142 - RNA, 10 nt, Homo sapiens
gggaguggcg

SEQ ID NO: 45143 - RNA, 13 nt, Homo sapiens
gggaguggcgcgc

SEQ ID NO: 45144 - RNA, 14 nt, Homo sapiens
gggaguggcgcgcg

SEQ ID NO: 45145 - RNA, 16 nt, Homo sapiens
gggaguggcgcgcgcc

SEQ ID NO: 45146 - RNA, 16 nt, Homo sapiens
gggauuguaaaauggu

SEQ ID NO: 45147 - RNA, 16 nt, Homo sapiens
gggcaagggaccugcu

SEQ ID NO: 45148 - RNA, 19 nt, Homo sapiens
gggcauggguuuuauuaua

SEQ ID NO: 45149 - RNA, 12 nt, Homo sapiens
gggccgacggag

SEQ ID NO: 45150 - RNA, 14 nt, Homo sapiens
gggccgacggagcc

SEQ ID NO: 45151 - RNA, 15 nt, Homo sapiens
gggccgacggagccg

SEQ ID NO: 45152 - RNA, 18 nt, Homo sapiens
gggccgacggagccggga

SEQ ID NO: 45153 - RNA, 12 nt, Homo sapiens
gggccuggcugg

SEQ ID NO: 45154 - RNA, 17 nt, Homo sapiens
gggccuggcugggagug

SEQ ID NO: 45155 - RNA, 14 nt, Homo sapiens
gggcgcggggcggg

SEQ ID NO: 45156 - RNA, 12 nt, Homo sapiens
gggcgcgguggc

SEQ ID NO: 45157 - RNA, 15 nt, Homo sapiens
gggcgcgugcaggca

SEQ ID NO: 45158 - RNA, 21 nt, Homo sapiens
gggcgcgugcaggcagcagga

SEQ ID NO: 45159 - RNA, 15 nt, Homo sapiens
gggcgcucgcuuccg

SEQ ID NO: 45160 - RNA, 12 nt, Homo sapiens
gggcggcggccc

SEQ ID NO: 45161 - RNA, 22 nt, Homo sapiens
gggcgggacacaggcuccaaac

SEQ ID NO: 45162 - RNA, 13 nt, Homo sapiens
gggcuacgcgcgc

SEQ ID NO: 45163 - RNA, 14 nt, Homo sapiens
gggcuacgcgcgcu

SEQ ID NO: 45164 - RNA, 13 nt, Homo sapiens
gggcugaugcagu

SEQ ID NO: 45165 - RNA, 20 nt, Homo sapiens
gggcuuuagggaccugcugu

SEQ ID NO: 45166 - RNA, 21 nt, Homo sapiens
gggcuuuagggaccugcuguu

SEQ ID NO: 45167 - RNA, 12 nt, Homo sapiens
ggggagcgagcc

SEQ ID NO: 45168 - RNA, 12 nt, Homo sapiens
ggggaggggcgc

SEQ ID NO: 45169 - RNA, 12 nt, Homo sapiens
ggggcgcgugca

SEQ ID NO: 45170 - RNA, 11 nt, Homo sapiens
ggggcgcucgc

SEQ ID NO: 45171 - RNA, 14 nt, Homo sapiens
ggggcgcucgcuuc

SEQ ID NO: 45172 - RNA, 17 nt, Homo sapiens
ggggcuuuagggaccug

SEQ ID NO: 45173 - RNA, 17 nt, Homo sapiens
gggguggguggggcagu

SEQ ID NO: 45174 - RNA, 19 nt, Homo sapiens
gggguuugccaugcuggcc

SEQ ID NO: 45175 - RNA, 14 nt, Homo sapiens
gggucucagugucc

SEQ ID NO: 45176 - RNA, 19 nt, Homo sapiens
gggucucccucuguugcca

SEQ ID NO: 45177 - RNA, 16 nt, Homo sapiens
gggugaacugcagcga

SEQ ID NO: 45178 - RNA, 14 nt, Homo sapiens
ggguggggcagugc

SEQ ID NO: 45179 - RNA, 15 nt, Homo sapiens
ggguggggcagugcu

SEQ ID NO: 45180 - RNA, 12 nt, Homo sapiens
ggguuucacaag

SEQ ID NO: 45181 - RNA, 16 nt, Homo sapiens
ggguuugccaugcugg

SEQ ID NO: 45182 - RNA, 12 nt, Homo sapiens
gguaaccucauu

SEQ ID NO: 45183 - RNA, 14 nt, Homo sapiens
gguacauauuucuu

SEQ ID NO: 45184 - RNA, 18 nt, Homo sapiens
gguauauaaauuuuccca

SEQ ID NO: 45185 - RNA, 19 nt, Homo sapiens
gguaucaaccaaauggagu

SEQ ID NO: 45186 - RNA, 12 nt, Homo sapiens
gguaugauuaac

SEQ ID NO: 45187 - RNA, 19 nt, Homo sapiens
gguauuuauugagcaccug

SEQ ID NO: 45188 - RNA, 19 nt, Homo sapiens
gguauuuuaaucaccaagg

SEQ ID NO: 45189 - RNA, 14 nt, Homo sapiens
ggucaacaugguga

SEQ ID NO: 45190 - RNA, 15 nt, Homo sapiens
ggucaacauggugaa

SEQ ID NO: 45191 - RNA, 20 nt, Homo sapiens
ggucaauuuuguuauguaua

SEQ ID NO: 45192 - RNA, 23 nt, Homo sapiens
ggucacuuuacuguccccaucau

SEQ ID NO: 45193 - RNA, 17 nt, Homo sapiens
gguccgaagucuuccau

SEQ ID NO: 45194 - RNA, 15 nt, Homo sapiens
gguccgggucgcagg

SEQ ID NO: 45195 - RNA, 15 nt, Homo sapiens
gguccuaagucccug

SEQ ID NO: 45196 - RNA, 16 nt, Homo sapiens
gguccuaagucccugc

SEQ ID NO: 45197 - RNA, 19 nt, Homo sapiens
gguccuaagucccugcugc

SEQ ID NO: 45198 - RNA, 17 nt, Homo sapiens
gguccuugcugcaccug

SEQ ID NO: 45199 - RNA, 18 nt, Homo sapiens
ggucgcaggaccaucccg

SEQ ID NO: 45200 - RNA, 22 nt, Homo sapiens
ggucgcaggaccaucccggccg

SEQ ID NO: 45201 - RNA, 23 nt, Homo sapiens
ggucgcaggaccaucccggccgg

SEQ ID NO: 45202 - RNA, 13 nt, Homo sapiens
ggucggguuuuau

SEQ ID NO: 45203 - RNA, 23 nt, Homo sapiens
ggucggguuuuauuguuuaaaau

SEQ ID NO: 45204 - RNA, 17 nt, Homo sapiens
ggucgucgucuugacuu

SEQ ID NO: 45205 - RNA, 23 nt, Homo sapiens
ggucgucgucuugacuuuggcaa

SEQ ID NO: 45206 - RNA, 21 nt, Homo sapiens
ggucuaccaaaaaucucaaua

SEQ ID NO: 45207 - RNA, 16 nt, Homo sapiens
ggucuaccuguucgcg

SEQ ID NO: 45208 - RNA, 19 nt, Homo sapiens
ggucucgaacugcuggauu

SEQ ID NO: 45209 - RNA, 20 nt, Homo sapiens
ggucuugauaaauggcuucc

SEQ ID NO: 45210 - RNA, 16 nt, Homo sapiens
ggugaaacccugucuc

SEQ ID NO: 45211 - RNA, 17 nt, Homo sapiens
ggugaacugcagcgagu

SEQ ID NO: 45212 - RNA, 14 nt, Homo sapiens
ggugagggcuugag

SEQ ID NO: 45213 - RNA, 18 nt, Homo sapiens
ggugagguaccagccuug

SEQ ID NO: 45214 - RNA, 15 nt, Homo sapiens
gguggcgcgcaccug

SEQ ID NO: 45215 - RNA, 23 nt, Homo sapiens
gguggcgcuggcugcgcucggcc

SEQ ID NO: 45216 - RNA, 17 nt, Homo sapiens
gguggcucacgccugua

SEQ ID NO: 45217 - RNA, 14 nt, Homo sapiens
gguggggcagugcu

SEQ ID NO: 45218 - RNA, 15 nt, Homo sapiens
gguggggcagugcuu

SEQ ID NO: 45219 - RNA, 13 nt, Homo sapiens
gguggguggggca

SEQ ID NO: 45220 - RNA, 14 nt, Homo sapiens
ggugugaccacugc

SEQ ID NO: 45221 - RNA, 23 nt, Homo sapiens
gguuaccaguaacggaacaguau

SEQ ID NO: 45222 - RNA, 17 nt, Homo sapiens
gguuaccuuuguuccca

SEQ ID NO: 45223 - RNA, 19 nt, Homo sapiens
gguuaccuuuguucccaaa

SEQ ID NO: 45224 - RNA, 22 nt, Homo sapiens
gguucuaggccgggcgcggugg

SEQ ID NO: 45225 - RNA, 19 nt, Homo sapiens
gguucuucuuggucucagu

SEQ ID NO: 45226 - RNA, 13 nt, Homo sapiens
gguugauuucagc

SEQ ID NO: 45227 - RNA, 20 nt, Homo sapiens
gguuucacaagugaaaaaca

SEQ ID NO: 45228 - RNA, 21 nt, Homo sapiens
gguuucacaagugaaaaacau

SEQ ID NO: 45229 - RNA, 19 nt, Homo sapiens
gguuugccaugcuggccag

SEQ ID NO: 45230 - RNA, 14 nt, Homo sapiens
gguuuggacaaaau

SEQ ID NO: 45231 - RNA, 16 nt, Homo sapiens
guaaaaccacagcagu

SEQ ID NO: 45232 - RNA, 16 nt, Homo sapiens
guaaaauggagacacc

SEQ ID NO: 45233 - RNA, 13 nt, Homo sapiens
guaaaauugaaag

SEQ ID NO: 45234 - RNA, 15 nt, Homo sapiens
guaaacaaaggaauu

SEQ ID NO: 45235 - RNA, 18 nt, Homo sapiens
guaaacggucucucacuu

SEQ ID NO: 45236 - RNA, 16 nt, Homo sapiens
guaaagcuuugugcag

SEQ ID NO: 45237 - RNA, 17 nt, Homo sapiens
guaaaguacagacuuuu

SEQ ID NO: 45238 - RNA, 18 nt, Homo sapiens
guaaaugggggugcauuu

SEQ ID NO: 45239 - RNA, 20 nt, Homo sapiens
guaaaugggggugcauuuga

SEQ ID NO: 45240 - RNA, 16 nt, Homo sapiens
guaacuggcaguuuuc

SEQ ID NO: 45241 - RNA, 23 nt, Homo sapiens
guaacuguuuagaugaaugucag

SEQ ID NO: 45242 - RNA, 15 nt, Homo sapiens
guaagggaaacugcc

SEQ ID NO: 45243 - RNA, 17 nt, Homo sapiens
guaagggaaacugccag

SEQ ID NO: 45244 - RNA, 18 nt, Homo sapiens
guaagggaaacugccagc

SEQ ID NO: 45245 - RNA, 18 nt, Homo sapiens
guaaguuuaugcauacag

SEQ ID NO: 45246 - RNA, 20 nt, Homo sapiens
guaauuggaaaggcagcucu

SEQ ID NO: 45247 - RNA, 17 nt, Homo sapiens
guaauuugugauacaau

SEQ ID NO: 45248 - RNA, 20 nt, Homo sapiens
guaauuugugauacaaugcu

SEQ ID NO: 45249 - RNA, 19 nt, Homo sapiens
guaauuuuaaguaauuuca

SEQ ID NO: 45250 - RNA, 23 nt, Homo sapiens
guaauuuuuuuaucgucacugcu

SEQ ID NO: 45251 - RNA, 19 nt, Homo sapiens
guacaucaaugauaaugcu

SEQ ID NO: 45252 - RNA, 17 nt, Homo sapiens
guacauguuaaacuuac

SEQ ID NO: 45253 - RNA, 22 nt, Homo sapiens
guacauuuccaaauucacaagu

SEQ ID NO: 45254 - RNA, 22 nt, Homo sapiens
guacauuuuuuuuuucaauaaa

SEQ ID NO: 45255 - RNA, 23 nt, Homo sapiens
guacauuuuuuuuuucaauaaaa

SEQ ID NO: 45256 - RNA, 16 nt, Homo sapiens
guaccgcaaugugacu

SEQ ID NO: 45257 - RNA, 14 nt, Homo sapiens
guaccucucuuaua

SEQ ID NO: 45258 - RNA, 20 nt, Homo sapiens
guaccuucucaccugugaga

SEQ ID NO: 45259 - RNA, 18 nt, Homo sapiens
guacgcgagcgcgcgcgc

SEQ ID NO: 45260 - RNA, 19 nt, Homo sapiens
guacgcgagcgcgcgcgcc

SEQ ID NO: 45261 - RNA, 15 nt, Homo sapiens
guacguugugcauuu

SEQ ID NO: 45262 - RNA, 15 nt, Homo sapiens
guacuccagccuggg

SEQ ID NO: 45263 - RNA, 16 nt, Homo sapiens
guacuccagccugggu

SEQ ID NO: 45264 - RNA, 16 nt, Homo sapiens
guacucugaaaguuuu

SEQ ID NO: 45265 - RNA, 15 nt, Homo sapiens
guacuuuuuccagac

SEQ ID NO: 45266 - RNA, 15 nt, Homo sapiens
guagauaaacucaga

SEQ ID NO: 45267 - RNA, 16 nt, Homo sapiens
guagauaaacucagaa

SEQ ID NO: 45268 - RNA, 17 nt, Homo sapiens
guagauaaacucagaaa

SEQ ID NO: 45269 - RNA, 16 nt, Homo sapiens
guagauaugaggcauu

SEQ ID NO: 45270 - RNA, 13 nt, Homo sapiens
guagcagcagcau

SEQ ID NO: 45271 - RNA, 15 nt, Homo sapiens
guagcguacaucaau

SEQ ID NO: 45272 - RNA, 18 nt, Homo sapiens
guagcucucugaccuccu

SEQ ID NO: 45273 - RNA, 21 nt, Homo sapiens
guauauaaauuuucccaaaac

SEQ ID NO: 45274 - RNA, 17 nt, Homo sapiens
guaucaaaagaaagaaa

SEQ ID NO: 45275 - RNA, 18 nt, Homo sapiens
guaucaaccaaauggagu

SEQ ID NO: 45276 - RNA, 16 nt, Homo sapiens
guauccuucagccuga

SEQ ID NO: 45277 - RNA, 22 nt, Homo sapiens
guaucuuguuuuuccacuacug

SEQ ID NO: 45278 - RNA, 13 nt, Homo sapiens
guaugaaaauguc

SEQ ID NO: 45279 - RNA, 14 nt, Homo sapiens
guaugaaaauguca

SEQ ID NO: 45280 - RNA, 18 nt, Homo sapiens
guaugaaaaugucauugu

SEQ ID NO: 45281 - RNA, 19 nt, Homo sapiens
guaugaaaaugucauuguu

SEQ ID NO: 45282 - RNA, 14 nt, Homo sapiens
guaugaggcauuug

SEQ ID NO: 45283 - RNA, 15 nt, Homo sapiens
guaugaggcauuugu

SEQ ID NO: 45284 - RNA, 13 nt, Homo sapiens
guaugauucccag

SEQ ID NO: 45285 - RNA, 20 nt, Homo sapiens
guaugcacuaaucaauacuu

SEQ ID NO: 45286 - RNA, 13 nt, Homo sapiens
guauggcaaacug

SEQ ID NO: 45287 - RNA, 17 nt, Homo sapiens
guauggcaaacugccau

SEQ ID NO: 45288 - RNA, 13 nt, Homo sapiens
guauggcagcuuu

SEQ ID NO: 45289 - RNA, 18 nt, Homo sapiens
guauucaaacaauuugaa

SEQ ID NO: 45290 - RNA, 18 nt, Homo sapiens
guauucccuuuugcugcc

SEQ ID NO: 45291 - RNA, 19 nt, Homo sapiens
guauucucuccuguaccuc

SEQ ID NO: 45292 - RNA, 18 nt, Homo sapiens
guauuuauugagcaccug

SEQ ID NO: 45293 - RNA, 19 nt, Homo sapiens
guauuucuaugaaauauua

SEQ ID NO: 45294 - RNA, 21 nt, Homo sapiens
gucaaacccaaguuaguucaa

SEQ ID NO: 45295 - RNA, 22 nt, Homo sapiens
gucaaacccaaguuaguucaau

SEQ ID NO: 45296 - RNA, 16 nt, Homo sapiens
gucaaauugugugaaa

SEQ ID NO: 45297 - RNA, 18 nt, Homo sapiens
gucaaggcuuagacccuc

SEQ ID NO: 45298 - RNA, 15 nt, Homo sapiens
gucaaugcagccccc

SEQ ID NO: 45299 - RNA, 16 nt, Homo sapiens
gucaaugcagccccca

SEQ ID NO: 45300 - RNA, 15 nt, Homo sapiens
gucacagaggaucug

SEQ ID NO: 45301 - RNA, 16 nt, Homo sapiens
gucacagaggaucugc

SEQ ID NO: 45302 - RNA, 19 nt, Homo sapiens
gucacagaggaucugcuug

SEQ ID NO: 45303 - RNA, 15 nt, Homo sapiens
gucacuagggcaggg

SEQ ID NO: 45304 - RNA, 15 nt, Homo sapiens
gucacuuuacugucc

SEQ ID NO: 45305 - RNA, 11 nt, Homo sapiens
gucagccagcc

SEQ ID NO: 45306 - RNA, 22 nt, Homo sapiens
gucauuauguuaauauuucuga

SEQ ID NO: 45307 - RNA, 20 nt, Homo sapiens
gucauucagauaugauucaa

SEQ ID NO: 45308 - RNA, 13 nt, Homo sapiens
gucauuuguuaau

SEQ ID NO: 45309 - RNA, 16 nt, Homo sapiens
guccacugguucuucu

SEQ ID NO: 45310 - RNA, 23 nt, Homo sapiens
guccauucuuccucccauucagg

SEQ ID NO: 45311 - RNA, 13 nt, Homo sapiens
gucccagcgaggg

SEQ ID NO: 45312 - RNA, 17 nt, Homo sapiens
guccccagagcuacagg

SEQ ID NO: 45313 - RNA, 19 nt, Homo sapiens
guccccagagcuacaggcc

SEQ ID NO: 45314 - RNA, 19 nt, Homo sapiens
gucccuagcccuuacgucc

SEQ ID NO: 45315 - RNA, 20 nt, Homo sapiens
gucccuagcccuuacguccu

SEQ ID NO: 45316 - RNA, 13 nt, Homo sapiens
gucccugcugccc

SEQ ID NO: 45317 - RNA, 17 nt, Homo sapiens
guccgggucgcaggacc

SEQ ID NO: 45318 - RNA, 20 nt, Homo sapiens
guccgggucgcaggaccauc

SEQ ID NO: 45319 - RNA, 20 nt, Homo sapiens
guccuaagucccugcugccc

SEQ ID NO: 45320 - RNA, 16 nt, Homo sapiens
guccuauuauauucau

SEQ ID NO: 45321 - RNA, 20 nt, Homo sapiens
gucgcaggaccaucccggcc

SEQ ID NO: 45322 - RNA, 22 nt, Homo sapiens
gucgcaggaccaucccggccgg

SEQ ID NO: 45323 - RNA, 24 nt, Homo sapiens
gucgcaggaccaucccggccggcg

SEQ ID NO: 45324 - RNA, 12 nt, Homo sapiens
gucgccggcauc

SEQ ID NO: 45325 - RNA, 14 nt, Homo sapiens
gucgccggcaucuu

SEQ ID NO: 45326 - RNA, 19 nt, Homo sapiens
gucuaccuguucgcgcgcc

SEQ ID NO: 45327 - RNA, 22 nt, Homo sapiens
gucuaccuguucgcgcgccucc

SEQ ID NO: 45328 - RNA, 11 nt, Homo sapiens
gucuagugaaa

SEQ ID NO: 45329 - RNA, 15 nt, Homo sapiens
gucucaguccaugaa

SEQ ID NO: 45330 - RNA, 16 nt, Homo sapiens
gucucaguccaugaag

SEQ ID NO: 45331 - RNA, 14 nt, Homo sapiens
gucucccaaagugc

SEQ ID NO: 45332 - RNA, 16 nt, Homo sapiens
gucucccaaagugcug

SEQ ID NO: 45333 - RNA, 21 nt, Homo sapiens
gucucccucuguugccaaggc

SEQ ID NO: 45334 - RNA, 23 nt, Homo sapiens
gucucgugguaggacuguagaaa

SEQ ID NO: 45335 - RNA, 18 nt, Homo sapiens
gucucugaagugaaacug

SEQ ID NO: 45336 - RNA, 21 nt, Homo sapiens
gucucugaagugaaacugcuu

SEQ ID NO: 45337 - RNA, 22 nt, Homo sapiens
gucugaaauuuucuagaauacu

SEQ ID NO: 45338 - RNA, 15 nt, Homo sapiens
gucugacuguuucca

SEQ ID NO: 45339 - RNA, 21 nt, Homo sapiens
gucuuaauuaaaagaauauuu

SEQ ID NO: 45340 - RNA, 22 nt, Homo sapiens
gucuucacaacagauuauuacc

SEQ ID NO: 45341 - RNA, 13 nt, Homo sapiens
gucuuguguuucu

SEQ ID NO: 45342 - RNA, 21 nt, Homo sapiens
gucuuguguuucuuuaguuuu

SEQ ID NO: 45343 - RNA, 15 nt, Homo sapiens
gugaaagguacuuca

SEQ ID NO: 45344 - RNA, 20 nt, Homo sapiens
gugaaauaaaaguagaauaa

SEQ ID NO: 45345 - RNA, 14 nt, Homo sapiens
gugaaauaagccag

SEQ ID NO: 45346 - RNA, 20 nt, Homo sapiens
gugaaauaagccagacauca

SEQ ID NO: 45347 - RNA, 23 nt, Homo sapiens
gugaacaaauuuacagagacaga

SEQ ID NO: 45348 - RNA, 14 nt, Homo sapiens
gugaacacaucagc

SEQ ID NO: 45349 - RNA, 15 nt, Homo sapiens
gugaacacaucagcu

SEQ ID NO: 45350 - RNA, 23 nt, Homo sapiens
gugaacugcagcgaguacuuccc

SEQ ID NO: 45351 - RNA, 16 nt, Homo sapiens
gugaaguauacuguau

SEQ ID NO: 45352 - RNA, 16 nt, Homo sapiens
gugacaagcucacaga

SEQ ID NO: 45353 - RNA, 17 nt, Homo sapiens
gugaccugacagcccaa

SEQ ID NO: 45354 - RNA, 21 nt, Homo sapiens
gugaccugacagcccaagggu

SEQ ID NO: 45355 - RNA, 17 nt, Homo sapiens
gugacuauuauauuucc

SEQ ID NO: 45356 - RNA, 13 nt, Homo sapiens
gugacuggccugc

SEQ ID NO: 45357 - RNA, 16 nt, Homo sapiens
gugagacagcucugca

SEQ ID NO: 45358 - RNA, 17 nt, Homo sapiens
gugagacagcucugcau

SEQ ID NO: 45359 - RNA, 18 nt, Homo sapiens
gugagaccaaauugagcu

SEQ ID NO: 45360 - RNA, 20 nt, Homo sapiens
gugagaccaaauugagcuag

SEQ ID NO: 45361 - RNA, 14 nt, Homo sapiens
gugagaucaaugug

SEQ ID NO: 45362 - RNA, 12 nt, Homo sapiens
gugagccaccaa

SEQ ID NO: 45363 - RNA, 13 nt, Homo sapiens
gugagccaccaaa

SEQ ID NO: 45364 - RNA, 20 nt, Homo sapiens
gugagccaccaaacccggcc

SEQ ID NO: 45365 - RNA, 13 nt, Homo sapiens
gugauacaaugcu

SEQ ID NO: 45366 - RNA, 16 nt, Homo sapiens
gugauuaccagggacu

SEQ ID NO: 45367 - RNA, 17 nt, Homo sapiens
gugauuaccagggacug

SEQ ID NO: 45368 - RNA, 20 nt, Homo sapiens
gugauuacccucugggucuc

SEQ ID NO: 45369 - RNA, 23 nt, Homo sapiens
gugauucccuccugcuacucugu

SEQ ID NO: 45370 - RNA, 12 nt, Homo sapiens
gugcaauaugug

SEQ ID NO: 45371 - RNA, 13 nt, Homo sapiens
gugcaauauguga

SEQ ID NO: 45372 - RNA, 14 nt, Homo sapiens
gugcacauauccuu

SEQ ID NO: 45373 - RNA, 15 nt, Homo sapiens
gugcagauucuuuac

SEQ ID NO: 45374 - RNA, 15 nt, Homo sapiens
gugcauauuuuauua

SEQ ID NO: 45375 - RNA, 17 nt, Homo sapiens
gugcauauuuuauuaua

SEQ ID NO: 45376 - RNA, 20 nt, Homo sapiens
gugcauuuggugguuucaga

SEQ ID NO: 45377 - RNA, 13 nt, Homo sapiens
gugccucaccccu

SEQ ID NO: 45378 - RNA, 23 nt, Homo sapiens
gugcggccuggucuaccuguucg

SEQ ID NO: 45379 - RNA, 18 nt, Homo sapiens
gugcuacaaaaacacagc

SEQ ID NO: 45380 - RNA, 20 nt, Homo sapiens
gugcugggaauuacaggcgu

SEQ ID NO: 45381 - RNA, 21 nt, Homo sapiens
gugcugggaauuacaggcgug

SEQ ID NO: 45382 - RNA, 12 nt, Homo sapiens
gugcuuggccca

SEQ ID NO: 45383 - RNA, 14 nt, Homo sapiens
gugcuuggcccagg

SEQ ID NO: 45384 - RNA, 15 nt, Homo sapiens
gugcuuggcccagga

SEQ ID NO: 45385 - RNA, 23 nt, Homo sapiens
gugcuuuaauggcaugucagaca

SEQ ID NO: 45386 - RNA, 20 nt, Homo sapiens
gugcuuuuaaaaaaaaauac

SEQ ID NO: 45387 - RNA, 21 nt, Homo sapiens
gugcuuuuaaaaaaaaauacu

SEQ ID NO: 45388 - RNA, 16 nt, Homo sapiens
guggaacaguuaccuc

SEQ ID NO: 45389 - RNA, 13 nt, Homo sapiens
guggagggggcgc

SEQ ID NO: 45390 - RNA, 18 nt, Homo sapiens
guggagggggcgcgugca

SEQ ID NO: 45391 - RNA, 12 nt, Homo sapiens
guggccagcuug

SEQ ID NO: 45392 - RNA, 12 nt, Homo sapiens
guggcgcgcgcc

SEQ ID NO: 45393 - RNA, 16 nt, Homo sapiens
guggcgcgcgccacca

SEQ ID NO: 45394 - RNA, 15 nt, Homo sapiens
guggcgcuggcugcg

SEQ ID NO: 45395 - RNA, 20 nt, Homo sapiens
guggcgcuggcugcgcucgg

SEQ ID NO: 45396 - RNA, 23 nt, Homo sapiens
gugggacagucaccucauggaau

SEQ ID NO: 45397 - RNA, 20 nt, Homo sapiens
gugggccugagaccaaggcc

SEQ ID NO: 45398 - RNA, 11 nt, Homo sapiens
gugggcucugg

SEQ ID NO: 45399 - RNA, 20 nt, Homo sapiens
guggggcagugcuuggccca

SEQ ID NO: 45400 - RNA, 21 nt, Homo sapiens
guggggcagugcuuggcccag

SEQ ID NO: 45401 - RNA, 23 nt, Homo sapiens
guggggcagugcuuggcccagga

SEQ ID NO: 45402 - RNA, 19 nt, Homo sapiens
guguacagucuuguauuaa

SEQ ID NO: 45403 - RNA, 16 nt, Homo sapiens
gugucaaugcagcccc

SEQ ID NO: 45404 - RNA, 17 nt, Homo sapiens
gugucaaugcagccccc

SEQ ID NO: 45405 - RNA, 15 nt, Homo sapiens
gugucaguggaugcu

SEQ ID NO: 45406 - RNA, 15 nt, Homo sapiens
gugucuggcacuugg

SEQ ID NO: 45407 - RNA, 16 nt, Homo sapiens
gugucuuaauuaaaag

SEQ ID NO: 45408 - RNA, 22 nt, Homo sapiens
gugugaccacugcagaagacag

SEQ ID NO: 45409 - RNA, 14 nt, Homo sapiens
gugugacucauuaa

SEQ ID NO: 45410 - RNA, 12 nt, Homo sapiens
gugugcuggcuu

SEQ ID NO: 45411 - RNA, 23 nt, Homo sapiens
guguguuuauuucacuugaugau

SEQ ID NO: 45412 - RNA, 13 nt, Homo sapiens
guguuugagcauc

SEQ ID NO: 45413 - RNA, 14 nt, Homo sapiens
guuaaaauaccagc

SEQ ID NO: 45414 - RNA, 22 nt, Homo sapiens
guuaagcacuuuaacacagugu

SEQ ID NO: 45415 - RNA, 18 nt, Homo sapiens
guuaaguaucagcuacaa

SEQ ID NO: 45416 - RNA, 23 nt, Homo sapiens
guuaguucaauccugauucauau

SEQ ID NO: 45417 - RNA, 15 nt, Homo sapiens
guuaucuucacuuuu

SEQ ID NO: 45418 - RNA, 16 nt, Homo sapiens
guuaucuucacuuuua

SEQ ID NO: 45419 - RNA, 17 nt, Homo sapiens
guuaucuucacuuuuau

SEQ ID NO: 45420 - RNA, 16 nt, Homo sapiens
guuaugauuaaguaau

SEQ ID NO: 45421 - RNA, 15 nt, Homo sapiens
guuauggcuuaauga

SEQ ID NO: 45422 - RNA, 13 nt, Homo sapiens
guuauuaaaaauc

SEQ ID NO: 45423 - RNA, 15 nt, Homo sapiens
guuauuaaaaaucuc

SEQ ID NO: 45424 - RNA, 19 nt, Homo sapiens
guuauuuagggaacugcuu

SEQ ID NO: 45425 - RNA, 20 nt, Homo sapiens
guuauuuagggaacugcuug

SEQ ID NO: 45426 - RNA, 21 nt, Homo sapiens
guuauuuagggaacugcuuga

SEQ ID NO: 45427 - RNA, 15 nt, Homo sapiens
guuauuuauaaucac

SEQ ID NO: 45428 - RNA, 19 nt, Homo sapiens
guuauuuauugaaaugauu

SEQ ID NO: 45429 - RNA, 11 nt, Homo sapiens
guuauuuuuaa

SEQ ID NO: 45430 - RNA, 18 nt, Homo sapiens
guuauuuuuaauuugguu

SEQ ID NO: 45431 - RNA, 21 nt, Homo sapiens
guucaaucuggauucauauuu

SEQ ID NO: 45432 - RNA, 20 nt, Homo sapiens
guucacagccagacuggcac

SEQ ID NO: 45433 - RNA, 18 nt, Homo sapiens
guuccuaaccagccuggu

SEQ ID NO: 45434 - RNA, 19 nt, Homo sapiens
guuccuaaccagccugguc

SEQ ID NO: 45435 - RNA, 22 nt, Homo sapiens
guuccugagaccagccaaccug

SEQ ID NO: 45436 - RNA, 10 nt, Homo sapiens
guucgcgcgc

SEQ ID NO: 45437 - RNA, 13 nt, Homo sapiens
guucgcgcgccuc

SEQ ID NO: 45438 - RNA, 15 nt, Homo sapiens
guucuaggccgggcg

SEQ ID NO: 45439 - RNA, 12 nt, Homo sapiens
guucuauaacaa

SEQ ID NO: 45440 - RNA, 13 nt, Homo sapiens
guucuauaacaac

SEQ ID NO: 45441 - RNA, 14 nt, Homo sapiens
guucuauaacaaca

SEQ ID NO: 45442 - RNA, 20 nt, Homo sapiens
guucucuucuuuaaagggau

SEQ ID NO: 45443 - RNA, 21 nt, Homo sapiens
guucucuucuuuaaagggaug

SEQ ID NO: 45444 - RNA, 11 nt, Homo sapiens
guucugaagaa

SEQ ID NO: 45445 - RNA, 23 nt, Homo sapiens
guucuucccuuuuacauacugcu

SEQ ID NO: 45446 - RNA, 18 nt, Homo sapiens
guucuucuuggucucagu

SEQ ID NO: 45447 - RNA, 16 nt, Homo sapiens
guucuugugaacccaa

SEQ ID NO: 45448 - RNA, 19 nt, Homo sapiens
guucuuuccaaaguacacu

SEQ ID NO: 45449 - RNA, 19 nt, Homo sapiens
guugaaaaaguucugcaga

SEQ ID NO: 45450 - RNA, 12 nt, Homo sapiens
guugaaaagacu

SEQ ID NO: 45451 - RNA, 16 nt, Homo sapiens
guugaagagguuuuaa

SEQ ID NO: 45452 - RNA, 15 nt, Homo sapiens
guugacaacugugac

SEQ ID NO: 45453 - RNA, 19 nt, Homo sapiens
guugacaugggacauuugc

SEQ ID NO: 45454 - RNA, 22 nt, Homo sapiens
guugagcuguuuucccugaccu

SEQ ID NO: 45455 - RNA, 22 nt, Homo sapiens
guugauggaaauacacuguuau

SEQ ID NO: 45456 - RNA, 15 nt, Homo sapiens
guugccaaggcugga

SEQ ID NO: 45457 - RNA, 19 nt, Homo sapiens
guugccaaggcuggagugc

SEQ ID NO: 45458 - RNA, 18 nt, Homo sapiens
guugccuaauuuguuuuc

SEQ ID NO: 45459 - RNA, 23 nt, Homo sapiens
guugcuaucaauccaagaacuua

SEQ ID NO: 45460 - RNA, 16 nt, Homo sapiens
guuggaaaaugugcaa

SEQ ID NO: 45461 - RNA, 18 nt, Homo sapiens
guuggaaaaugugcaaua

SEQ ID NO: 45462 - RNA, 19 nt, Homo sapiens
guugucaaugggaaaaaac

SEQ ID NO: 45463 - RNA, 18 nt, Homo sapiens
guuguggggaugaacuuu

SEQ ID NO: 45464 - RNA, 19 nt, Homo sapiens
guuguuaauaaaaguacau

SEQ ID NO: 45465 - RNA, 21 nt, Homo sapiens
guuguuaauaaaaguacaugu

SEQ ID NO: 45466 - RNA, 14 nt, Homo sapiens
guuuaaauggucaa

SEQ ID NO: 45467 - RNA, 13 nt, Homo sapiens
guuuaauguuaau

SEQ ID NO: 45468 - RNA, 16 nt, Homo sapiens
guuuagaaagcuugcc

SEQ ID NO: 45469 - RNA, 20 nt, Homo sapiens
guuuagaaagcuugcccugg

SEQ ID NO: 45470 - RNA, 17 nt, Homo sapiens
guuuagaugaaugucag

SEQ ID NO: 45471 - RNA, 19 nt, Homo sapiens
guuuauauagaaauguauu

SEQ ID NO: 45472 - RNA, 22 nt, Homo sapiens
guuuaugcauagauaaucucuc

SEQ ID NO: 45473 - RNA, 19 nt, Homo sapiens
guuuauuuguuuuuccagu

SEQ ID NO: 45474 - RNA, 22 nt, Homo sapiens
guuucauaagaauucuguugau

SEQ ID NO: 45475 - RNA, 22 nt, Homo sapiens
guuucauauugaugugugucua

SEQ ID NO: 45476 - RNA, 16 nt, Homo sapiens
guuuccauagggugac

SEQ ID NO: 45477 - RNA, 17 nt, Homo sapiens
guuuccauagggugaca

SEQ ID NO: 45478 - RNA, 16 nt, Homo sapiens
guuuccuagcgcagcc

SEQ ID NO: 45479 - RNA, 21 nt, Homo sapiens
guuucgugaaguauacuguau

SEQ ID NO: 45480 - RNA, 18 nt, Homo sapiens
guuugaaaauaugccugc

SEQ ID NO: 45481 - RNA, 22 nt, Homo sapiens
guuugcagauauucucuaguca

SEQ ID NO: 45482 - RNA, 21 nt, Homo sapiens
guuuggccagaagucaaggcu

SEQ ID NO: 45483 - RNA, 15 nt, Homo sapiens
guuugugauugccau

SEQ ID NO: 45484 - RNA, 16 nt, Homo sapiens
guuugugauugccauu

SEQ ID NO: 45485 - RNA, 22 nt, Homo sapiens
guuuuauaugcuucuguuuuau

SEQ ID NO: 45486 - RNA, 21 nt, Homo sapiens
guuuucacaaagaacaggaaa

SEQ ID NO: 45487 - RNA, 14 nt, Homo sapiens
guuuucauuaucuc

SEQ ID NO: 45488 - RNA, 21 nt, Homo sapiens
guuuucccugaccucccucua

SEQ ID NO: 45489 - RNA, 17 nt, Homo sapiens
guuuuccuucucaucug

SEQ ID NO: 45490 - RNA, 19 nt, Homo sapiens
guuuuccuucucaucugug

SEQ ID NO: 45491 - RNA, 19 nt, Homo sapiens
guuuucugcuuuaauuuca

SEQ ID NO: 45492 - RNA, 16 nt, Homo sapiens
guuuugguugcuuuaa

SEQ ID NO: 45493 - RNA, 19 nt, Homo sapiens
guuuugugaagaaacauuu

SEQ ID NO: 45494 - RNA, 15 nt, Homo sapiens
guuuuuaagccuuaa

SEQ ID NO: 45495 - RNA, 22 nt, Homo sapiens
guuuuuauggcuuuugugcauu

SEQ ID NO: 45496 - RNA, 11 nt, Homo sapiens
guuuuucacau

SEQ ID NO: 45497 - RNA, 13 nt, Homo sapiens
guuuuucacauuu

SEQ ID NO: 45498 - RNA, 21 nt, Homo sapiens
uaaaaaaaaaaaaaaagccaa

SEQ ID NO: 45499 - RNA, 22 nt, Homo sapiens
uaaaaaaaaaaaaaaagccaaa

SEQ ID NO: 45500 - RNA, 19 nt, Homo sapiens
uaaaaaaaaaccugagccc

SEQ ID NO: 45501 - RNA, 17 nt, Homo sapiens
uaaaaaggcauguaauu

SEQ ID NO: 45502 - RNA, 12 nt, Homo sapiens
uaaaacaccuca

SEQ ID NO: 45503 - RNA, 20 nt, Homo sapiens
uaaaacaccucagcugccuc

SEQ ID NO: 45504 - RNA, 17 nt, Homo sapiens
uaaaaccugacagacca

SEQ ID NO: 45505 - RNA, 14 nt, Homo sapiens
uaaaacuaggugcu

SEQ ID NO: 45506 - RNA, 13 nt, Homo sapiens
uaaaacucauuuu

SEQ ID NO: 45507 - RNA, 14 nt, Homo sapiens
uaaaagaaugauua

SEQ ID NO: 45508 - RNA, 11 nt, Homo sapiens
uaaaagcacuu

SEQ ID NO: 45509 - RNA, 19 nt, Homo sapiens
uaaaaggccugucccugca

SEQ ID NO: 45510 - RNA, 14 nt, Homo sapiens
uaaaauaauuuuua

SEQ ID NO: 45511 - RNA, 16 nt, Homo sapiens
uaaaauacacacucaa

SEQ ID NO: 45512 - RNA, 21 nt, Homo sapiens
uaaaauauuuuuaugugcaau

SEQ ID NO: 45513 - RNA, 22 nt, Homo sapiens
uaaaauauuuuuaugugcaaua

SEQ ID NO: 45514 - RNA, 23 nt, Homo sapiens
uaaaauauuuuuaugugcaauaa

SEQ ID NO: 45515 - RNA, 21 nt, Homo sapiens
uaaaaucacaaacucauccau

SEQ ID NO: 45516 - RNA, 19 nt, Homo sapiens
uaaaaucauuucugcauca

SEQ ID NO: 45517 - RNA, 14 nt, Homo sapiens
uaaaaucuaauuca

SEQ ID NO: 45518 - RNA, 18 nt, Homo sapiens
uaaaauuaucaauaucua

SEQ ID NO: 45519 - RNA, 10 nt, Homo sapiens
uaaaauuuuu

SEQ ID NO: 45520 - RNA, 21 nt, Homo sapiens
uaaaauuuuuauguaauuaua

SEQ ID NO: 45521 - RNA, 17 nt, Homo sapiens
uaaacaaaggaauuaug

SEQ ID NO: 45522 - RNA, 19 nt, Homo sapiens
uaaacacuaaaaaggcaug

SEQ ID NO: 45523 - RNA, 15 nt, Homo sapiens
uaaacaguagugaua

SEQ ID NO: 45524 - RNA, 22 nt, Homo sapiens
uaaaccgaacugauguaaguaa

SEQ ID NO: 45525 - RNA, 13 nt, Homo sapiens
uaaaccuaugaau

SEQ ID NO: 45526 - RNA, 17 nt, Homo sapiens
uaaacuguaaagcuuug

SEQ ID NO: 45527 - RNA, 20 nt, Homo sapiens
uaaagaucugcaacuacuau

SEQ ID NO: 45528 - RNA, 16 nt, Homo sapiens
uaaagaugaaugucag

SEQ ID NO: 45529 - RNA, 17 nt, Homo sapiens
uaaagaugaaugucagu

SEQ ID NO: 45530 - RNA, 16 nt, Homo sapiens
uaaagcuuugugcaga

SEQ ID NO: 45531 - RNA, 17 nt, Homo sapiens
uaaagguccuggcaaag

SEQ ID NO: 45532 - RNA, 14 nt, Homo sapiens
uaaaguacagacuu

SEQ ID NO: 45533 - RNA, 16 nt, Homo sapiens
uaaaguacagacuuuu

SEQ ID NO: 45534 - RNA, 14 nt, Homo sapiens
uaaaguaugugcau

SEQ ID NO: 45535 - RNA, 15 nt, Homo sapiens
uaaaguaugugcaua

SEQ ID NO: 45536 - RNA, 16 nt, Homo sapiens
uaaaguaugugcauau

SEQ ID NO: 45537 - RNA, 15 nt, Homo sapiens
uaaaguucuagugac

SEQ ID NO: 45538 - RNA, 13 nt, Homo sapiens
uaaauagcuuuuu

SEQ ID NO: 45539 - RNA, 17 nt, Homo sapiens
uaaauagcuuuuuucuc

SEQ ID NO: 45540 - RNA, 18 nt, Homo sapiens
uaaauaguuuaugauucc

SEQ ID NO: 45541 - RNA, 22 nt, Homo sapiens
uaaauauaaagcaagauaauaa

SEQ ID NO: 45542 - RNA, 23 nt, Homo sapiens
uaaauauaaagcaagauaauaaa

SEQ ID NO: 45543 - RNA, 19 nt, Homo sapiens
uaaauaucuagaaaugaua

SEQ ID NO: 45544 - RNA, 16 nt, Homo sapiens
uaaaugauuucauuca

SEQ ID NO: 45545 - RNA, 17 nt, Homo sapiens
uaaauggaaguaaaugu

SEQ ID NO: 45546 - RNA, 19 nt, Homo sapiens
uaaauguaucuuauucaca

SEQ ID NO: 45547 - RNA, 20 nt, Homo sapiens
uaacaaaauuugaauagccc

SEQ ID NO: 45548 - RNA, 24 nt, Homo sapiens
uaacaaugcuguauuuuaaaagaa

SEQ ID NO: 45549 - RNA, 16 nt, Homo sapiens
uaacaggaauuuucau

SEQ ID NO: 45550 - RNA, 19 nt, Homo sapiens
uaaccaguguuguggauuu

SEQ ID NO: 45551 - RNA, 21 nt, Homo sapiens
uaaccaugcccaagaaugaga

SEQ ID NO: 45552 - RNA, 12 nt, Homo sapiens
uaacuagaauuu

SEQ ID NO: 45553 - RNA, 23 nt, Homo sapiens
uaacucagaaacaucaguuacuc

SEQ ID NO: 45554 - RNA, 18 nt, Homo sapiens
uaacucuaccugcacacu

SEQ ID NO: 45555 - RNA, 16 nt, Homo sapiens
uaacugacaacuugaa

SEQ ID NO: 45556 - RNA, 21 nt, Homo sapiens
uaacugcauugagaacugcau

SEQ ID NO: 45557 - RNA, 15 nt, Homo sapiens
uaagaaaaaggaugc

SEQ ID NO: 45558 - RNA, 16 nt, Homo sapiens
uaagaaaaaggaugca

SEQ ID NO: 45559 - RNA, 19 nt, Homo sapiens
uaagaaaaaggaugcacag

SEQ ID NO: 45560 - RNA, 19 nt, Homo sapiens
uaagaacuaaaauguucua

SEQ ID NO: 45561 - RNA, 23 nt, Homo sapiens
uaagaagacugcauuauauuuau

SEQ ID NO: 45562 - RNA, 21 nt, Homo sapiens
uaagacaaaaagcuacuuauu

SEQ ID NO: 45563 - RNA, 21 nt, Homo sapiens
uaagagauggguuugacaagg

SEQ ID NO: 45564 - RNA, 19 nt, Homo sapiens
uaagauauuaacugagaag

SEQ ID NO: 45565 - RNA, 20 nt, Homo sapiens
uaagcaaaaugugauaugua

SEQ ID NO: 45566 - RNA, 16 nt, Homo sapiens
uaagcaaagacuauga

SEQ ID NO: 45567 - RNA, 20 nt, Homo sapiens
uaagcacuuuaacacagugu

SEQ ID NO: 45568 - RNA, 17 nt, Homo sapiens
uaagcauauacuagaua

SEQ ID NO: 45569 - RNA, 12 nt, Homo sapiens
uaaggaaacugg

SEQ ID NO: 45570 - RNA, 14 nt, Homo sapiens
uaagggaaacugcc

SEQ ID NO: 45571 - RNA, 16 nt, Homo sapiens
uaaggggaauugagga

SEQ ID NO: 45572 - RNA, 13 nt, Homo sapiens
uaaguaauuucag

SEQ ID NO: 45573 - RNA, 13 nt, Homo sapiens
uaagugcagcccc

SEQ ID NO: 45574 - RNA, 14 nt, Homo sapiens
uaaguuacauaagg

SEQ ID NO: 45575 - RNA, 20 nt, Homo sapiens
uaaguuuaugcauacaguaa

SEQ ID NO: 45576 - RNA, 19 nt, Homo sapiens
uaaguuucacagcacuuac

SEQ ID NO: 45577 - RNA, 16 nt, Homo sapiens
uaauaaaaguacaugu

SEQ ID NO: 45578 - RNA, 22 nt, Homo sapiens
uaauagaaauaaaccuaugaau

SEQ ID NO: 45579 - RNA, 18 nt, Homo sapiens
uaauagaauuaauggaau

SEQ ID NO: 45580 - RNA, 18 nt, Homo sapiens
uaauaucaucaguauuga

SEQ ID NO: 45581 - RNA, 22 nt, Homo sapiens
uaauauuucuucgugaugacau

SEQ ID NO: 45582 - RNA, 15 nt, Homo sapiens
uaaucccagcacuuu

SEQ ID NO: 45583 - RNA, 20 nt, Homo sapiens
uaaucccagcuacuugggag

SEQ ID NO: 45584 - RNA, 13 nt, Homo sapiens
uaaucuuucacag

SEQ ID NO: 45585 - RNA, 23 nt, Homo sapiens
uaaugaaaaugaauaucuauuaa

SEQ ID NO: 45586 - RNA, 15 nt, Homo sapiens
uaaugauaacuggaa

SEQ ID NO: 45587 - RNA, 16 nt, Homo sapiens
uaaugauaacuggaaa

SEQ ID NO: 45588 - RNA, 19 nt, Homo sapiens
uaauguagauaaagcacug

SEQ ID NO: 45589 - RNA, 12 nt, Homo sapiens
uaauguuucaaa

SEQ ID NO: 45590 - RNA, 12 nt, Homo sapiens
uaauuaugcagu

SEQ ID NO: 45591 - RNA, 15 nt, Homo sapiens
uaauuauuucacuuu

SEQ ID NO: 45592 - RNA, 17 nt, Homo sapiens
uaauuauuucacuuuag

SEQ ID NO: 45593 - RNA, 21 nt, Homo sapiens
uaauuuaucuugucucugggc

SEQ ID NO: 45594 - RNA, 13 nt, Homo sapiens
uaauuucagaaga

SEQ ID NO: 45595 - RNA, 15 nt, Homo sapiens
uaauuugguuuucac

SEQ ID NO: 45596 - RNA, 18 nt, Homo sapiens
uaauuuuaaguaauuuca

SEQ ID NO: 45597 - RNA, 14 nt, Homo sapiens
uacaaaaacacagc

SEQ ID NO: 45598 - RNA, 16 nt, Homo sapiens
uacaaaaacacagcaa

SEQ ID NO: 45599 - RNA, 18 nt, Homo sapiens
uacaaaaauuagccgggc

SEQ ID NO: 45600 - RNA, 21 nt, Homo sapiens
uacaaaauauagcuuucauaa

SEQ ID NO: 45601 - RNA, 14 nt, Homo sapiens
uacaaggcuuuauc

SEQ ID NO: 45602 - RNA, 20 nt, Homo sapiens
uacaaggcuuuaucucaggg

SEQ ID NO: 45603 - RNA, 19 nt, Homo sapiens
uacaaugcauucugaggua

SEQ ID NO: 45604 - RNA, 17 nt, Homo sapiens
uacaauugaaaugacua

SEQ ID NO: 45605 - RNA, 14 nt, Homo sapiens
uacaauuguaaacu

SEQ ID NO: 45606 - RNA, 20 nt, Homo sapiens
uacacauuuuucagauauaa

SEQ ID NO: 45607 - RNA, 16 nt, Homo sapiens
uacacugccuucucaa

SEQ ID NO: 45608 - RNA, 17 nt, Homo sapiens
uacagaaaaguugaauu

SEQ ID NO: 45609 - RNA, 20 nt, Homo sapiens
uacagaaaaguugaauuuua

SEQ ID NO: 45610 - RNA, 13 nt, Homo sapiens
uacagccaggcgg

SEQ ID NO: 45611 - RNA, 20 nt, Homo sapiens
uacaguggggaaugaagaua

SEQ ID NO: 45612 - RNA, 20 nt, Homo sapiens
uacaguuacucagaauucuc

SEQ ID NO: 45613 - RNA, 18 nt, Homo sapiens
uacaguuagagauuuuua

SEQ ID NO: 45614 - RNA, 15 nt, Homo sapiens
uacauaaaguaugug

SEQ ID NO: 45615 - RNA, 19 nt, Homo sapiens
uacauaaaguaugugcaua

SEQ ID NO: 45616 - RNA, 20 nt, Homo sapiens
uacauaaaguaugugcauau

SEQ ID NO: 45617 - RNA, 21 nt, Homo sapiens
uacauaaugcgugcauaccac

SEQ ID NO: 45618 - RNA, 21 nt, Homo sapiens
uacauauuucuuugccuuuau

SEQ ID NO: 45619 - RNA, 21 nt, Homo sapiens
uacaucccuuaccugggaaag

SEQ ID NO: 45620 - RNA, 15 nt, Homo sapiens
uacaucuuucacauu

SEQ ID NO: 45621 - RNA, 18 nt, Homo sapiens
uacauguauuuguuugca

SEQ ID NO: 45622 - RNA, 18 nt, Homo sapiens
uacauuauuggacuucca

SEQ ID NO: 45623 - RNA, 12 nt, Homo sapiens
uacauucugcuu

SEQ ID NO: 45624 - RNA, 16 nt, Homo sapiens
uacauucugcuuucau

SEQ ID NO: 45625 - RNA, 13 nt, Homo sapiens
uacauuuccaaau

SEQ ID NO: 45626 - RNA, 15 nt, Homo sapiens
uacauuuguauaaaa

SEQ ID NO: 45627 - RNA, 20 nt, Homo sapiens
uacauuuguauaaaauaauu

SEQ ID NO: 45628 - RNA, 20 nt, Homo sapiens
uacauuuuuuuuuucaauaa

SEQ ID NO: 45629 - RNA, 21 nt, Homo sapiens
uacauuuuuuuuuucaauaaa

SEQ ID NO: 45630 - RNA, 22 nt, Homo sapiens
uaccagccuuggauacuccaug

SEQ ID NO: 45631 - RNA, 22 nt, Homo sapiens
uaccagggacugaggggagggg

SEQ ID NO: 45632 - RNA, 23 nt, Homo sapiens
uaccaugaugcugagcccggaaa

SEQ ID NO: 45633 - RNA, 17 nt, Homo sapiens
uaccucugauaccucaa

SEQ ID NO: 45634 - RNA, 14 nt, Homo sapiens
uaccugcacacugu

SEQ ID NO: 45635 - RNA, 16 nt, Homo sapiens
uaccuguucgcgcgcc

SEQ ID NO: 45636 - RNA, 22 nt, Homo sapiens
uaccuguucgcgcgccuccgcu

SEQ ID NO: 45637 - RNA, 11 nt, Homo sapiens
uaccuucucac

SEQ ID NO: 45638 - RNA, 13 nt, Homo sapiens
uacgcgagcgcgc

SEQ ID NO: 45639 - RNA, 14 nt, Homo sapiens
uacgcgagcgcgcg

SEQ ID NO: 45640 - RNA, 15 nt, Homo sapiens
uacgcgagcgcgcgc

SEQ ID NO: 45641 - RNA, 17 nt, Homo sapiens
uacgcgagcgcgcgcgc

SEQ ID NO: 45642 - RNA, 20 nt, Homo sapiens
uacgcgagcgcgcgcgcccu

SEQ ID NO: 45643 - RNA, 13 nt, Homo sapiens
uacgcgcgcuccg

SEQ ID NO: 45644 - RNA, 14 nt, Homo sapiens
uacgcgcgcuccgc

SEQ ID NO: 45645 - RNA, 22 nt, Homo sapiens
uacgugggcauucaaauguauu

SEQ ID NO: 45646 - RNA, 12 nt, Homo sapiens
uacguugugcau

SEQ ID NO: 45647 - RNA, 13 nt, Homo sapiens
uacguugugcauu

SEQ ID NO: 45648 - RNA, 16 nt, Homo sapiens
uacguugugcauuugg

SEQ ID NO: 45649 - RNA, 11 nt, Homo sapiens
uacuaaguuuu

SEQ ID NO: 45650 - RNA, 14 nt, Homo sapiens
uacuauauauguga

SEQ ID NO: 45651 - RNA, 22 nt, Homo sapiens
uacuauuuaagagaacaagcaa

SEQ ID NO: 45652 - RNA, 13 nt, Homo sapiens
uacuauuuaauua

SEQ ID NO: 45653 - RNA, 15 nt, Homo sapiens
uacucauacauguua

SEQ ID NO: 45654 - RNA, 17 nt, Homo sapiens
uacucauuaggauggcu

SEQ ID NO: 45655 - RNA, 18 nt, Homo sapiens
uacuccagccugggugac

SEQ ID NO: 45656 - RNA, 19 nt, Homo sapiens
uacuccagccugggugaca

SEQ ID NO: 45657 - RNA, 22 nt, Homo sapiens
uacucugaagggcaucaugcau

SEQ ID NO: 45658 - RNA, 11 nt, Homo sapiens
uacucuuauau

SEQ ID NO: 45659 - RNA, 12 nt, Homo sapiens
uacuguaagaaa

SEQ ID NO: 45660 - RNA, 19 nt, Homo sapiens
uacuuauuguagcauccug

SEQ ID NO: 45661 - RNA, 13 nt, Homo sapiens
uacuucaauacuu

SEQ ID NO: 45662 - RNA, 12 nt, Homo sapiens
uacuuccagggc

SEQ ID NO: 45663 - RNA, 13 nt, Homo sapiens
uacuuccagggcu

SEQ ID NO: 45664 - RNA, 20 nt, Homo sapiens
uacuucccgcuguuccucgc

SEQ ID NO: 45665 - RNA, 16 nt, Homo sapiens
uacuucuucucauacu

SEQ ID NO: 45666 - RNA, 20 nt, Homo sapiens
uagaaaacaggcaaauuccu

SEQ ID NO: 45667 - RNA, 16 nt, Homo sapiens
uagaaaagggaacuga

SEQ ID NO: 45668 - RNA, 14 nt, Homo sapiens
uagaagauggcacu

SEQ ID NO: 45669 - RNA, 16 nt, Homo sapiens
uagaagucacauuccu

SEQ ID NO: 45670 - RNA, 20 nt, Homo sapiens
uagaauaauacuagucuuau

SEQ ID NO: 45671 - RNA, 22 nt, Homo sapiens
uagaauacuaauaaaauacaua

SEQ ID NO: 45672 - RNA, 20 nt, Homo sapiens
uagaauauuuauuaccucug

SEQ ID NO: 45673 - RNA, 14 nt, Homo sapiens
uagaauguuuucaa

SEQ ID NO: 45674 - RNA, 13 nt, Homo sapiens
uagaauuuauuca

SEQ ID NO: 45675 - RNA, 13 nt, Homo sapiens
uagacccucaugc

SEQ ID NO: 45676 - RNA, 15 nt, Homo sapiens
uagagaauuuccuua

SEQ ID NO: 45677 - RNA, 17 nt, Homo sapiens
uagagacuuugugaaaa

SEQ ID NO: 45678 - RNA, 16 nt, Homo sapiens
uagaggcugaggaauc

SEQ ID NO: 45679 - RNA, 23 nt, Homo sapiens
uagaguucugucuggacuuucca

SEQ ID NO: 45680 - RNA, 16 nt, Homo sapiens
uagauaaacucagaaa

SEQ ID NO: 45681 - RNA, 14 nt, Homo sapiens
uagauagaugaaga

SEQ ID NO: 45682 - RNA, 15 nt, Homo sapiens
uagauagaugaagaa

SEQ ID NO: 45683 - RNA, 19 nt, Homo sapiens
uagaugaagaagcuagaaa

SEQ ID NO: 45684 - RNA, 12 nt, Homo sapiens
uagaugcaguuc

SEQ ID NO: 45685 - RNA, 18 nt, Homo sapiens
uagauucccugagcagga

SEQ ID NO: 45686 - RNA, 13 nt, Homo sapiens
uagauucuuuauu

SEQ ID NO: 45687 - RNA, 21 nt, Homo sapiens
uagcaaaucuacugucaauuu

SEQ ID NO: 45688 - RNA, 18 nt, Homo sapiens
uagcagauuuaagauaug

SEQ ID NO: 45689 - RNA, 20 nt, Homo sapiens
uagcauaguaccucugcuau

SEQ ID NO: 45690 - RNA, 21 nt, Homo sapiens
uagcauaguaccucugcuauu

SEQ ID NO: 45691 - RNA, 22 nt, Homo sapiens
uagcauaguaccucugcuauuu

SEQ ID NO: 45692 - RNA, 18 nt, Homo sapiens
uagcauccuggaauaucu

SEQ ID NO: 45693 - RNA, 13 nt, Homo sapiens
uagcaucucagga

SEQ ID NO: 45694 - RNA, 15 nt, Homo sapiens
uagccacuucacuuu

SEQ ID NO: 45695 - RNA, 15 nt, Homo sapiens
uagcccuuacguccu

SEQ ID NO: 45696 - RNA, 10 nt, Homo sapiens
uagccgggca

SEQ ID NO: 45697 - RNA, 22 nt, Homo sapiens
uagccgggcaugguggcgcgca

SEQ ID NO: 45698 - RNA, 19 nt, Homo sapiens
uagcgcagccaugugauua

SEQ ID NO: 45699 - RNA, 13 nt, Homo sapiens
uagcuaagauaua

SEQ ID NO: 45700 - RNA, 14 nt, Homo sapiens
uagcucucugaccu

SEQ ID NO: 45701 - RNA, 21 nt, Homo sapiens
uagcucucugaccuccuccuu

SEQ ID NO: 45702 - RNA, 14 nt, Homo sapiens
uagcuuuacuguuu

SEQ ID NO: 45703 - RNA, 14 nt, Homo sapiens
uagcuuucuuccug

SEQ ID NO: 45704 - RNA, 14 nt, Homo sapiens
uagcuuuuuucucu

SEQ ID NO: 45705 - RNA, 16 nt, Homo sapiens
uaggaacgguaaauuu

SEQ ID NO: 45706 - RNA, 14 nt, Homo sapiens
uagguuuggacaaa

SEQ ID NO: 45707 - RNA, 13 nt, Homo sapiens
uaguaauuggaaa

SEQ ID NO: 45708 - RNA, 16 nt, Homo sapiens
uaguaauuggaaaggc

SEQ ID NO: 45709 - RNA, 17 nt, Homo sapiens
uaguaauuggaaaggca

SEQ ID NO: 45710 - RNA, 16 nt, Homo sapiens
uaguaccucugcuauu

SEQ ID NO: 45711 - RNA, 19 nt, Homo sapiens
uaguaugaggcauuuguuu

SEQ ID NO: 45712 - RNA, 15 nt, Homo sapiens
uagucucuaucauua

SEQ ID NO: 45713 - RNA, 16 nt, Homo sapiens
uagucucuaucauuaa

SEQ ID NO: 45714 - RNA, 22 nt, Homo sapiens
uagugaaacucguuaauuugua

SEQ ID NO: 45715 - RNA, 17 nt, Homo sapiens
uagugaaucacguaaag

SEQ ID NO: 45716 - RNA, 22 nt, Homo sapiens
uagugaaucacguaaagcuaga

SEQ ID NO: 45717 - RNA, 14 nt, Homo sapiens
uaguggugugauuu

SEQ ID NO: 45718 - RNA, 14 nt, Homo sapiens
uaguguacaugaaa

SEQ ID NO: 45719 - RNA, 17 nt, Homo sapiens
uagugucugaugaaugu

SEQ ID NO: 45720 - RNA, 19 nt, Homo sapiens
uaguguuggaaaaugugca

SEQ ID NO: 45721 - RNA, 22 nt, Homo sapiens
uaguguuggaaaaugugcaaua

SEQ ID NO: 45722 - RNA, 23 nt, Homo sapiens
uaguguuggaaaaugugcaauau

SEQ ID NO: 45723 - RNA, 17 nt, Homo sapiens
uaguuacuaaacaugua

SEQ ID NO: 45724 - RNA, 22 nt, Homo sapiens
uaguuacuaaacauguauguaa

SEQ ID NO: 45725 - RNA, 11 nt, Homo sapiens
uaguuagcuuu

SEQ ID NO: 45726 - RNA, 19 nt, Homo sapiens
uaguucaauccugauucau

SEQ ID NO: 45727 - RNA, 12 nt, Homo sapiens
uaguucuacucc

SEQ ID NO: 45728 - RNA, 10 nt, Homo sapiens
uaguucuuca

SEQ ID NO: 45729 - RNA, 11 nt, Homo sapiens
uaguucuucaa

SEQ ID NO: 45730 - RNA, 14 nt, Homo sapiens
uaguuguaauuuuu

SEQ ID NO: 45731 - RNA, 19 nt, Homo sapiens
uaguuguaccgcaauguga

SEQ ID NO: 45732 - RNA, 17 nt, Homo sapiens
uaguuuaugauuccacc

SEQ ID NO: 45733 - RNA, 20 nt, Homo sapiens
uaguuucccuugcaugguuu

SEQ ID NO: 45734 - RNA, 16 nt, Homo sapiens
uauaaaagacugacca

SEQ ID NO: 45735 - RNA, 23 nt, Homo sapiens
uauaagugaagugauacuaucca

SEQ ID NO: 45736 - RNA, 12 nt, Homo sapiens
uauaauuuugug

SEQ ID NO: 45737 - RNA, 19 nt, Homo sapiens
uauacuauauuuuucucaa

SEQ ID NO: 45738 - RNA, 16 nt, Homo sapiens
uauagaaaugcugguu

SEQ ID NO: 45739 - RNA, 17 nt, Homo sapiens
uauagaauggaacucaa

SEQ ID NO: 45740 - RNA, 21 nt, Homo sapiens
uauaggugcuacaaaaacaca

SEQ ID NO: 45741 - RNA, 15 nt, Homo sapiens
uauaguaaugugacu

SEQ ID NO: 45742 - RNA, 17 nt, Homo sapiens
uauagucacuaguugua

SEQ ID NO: 45743 - RNA, 16 nt, Homo sapiens
uauaguucuacuccau

SEQ ID NO: 45744 - RNA, 14 nt, Homo sapiens
uauauaagcuugua

SEQ ID NO: 45745 - RNA, 12 nt, Homo sapiens
uauauauauuuu

SEQ ID NO: 45746 - RNA, 13 nt, Homo sapiens
uauaucaguccuc

SEQ ID NO: 45747 - RNA, 12 nt, Homo sapiens
uauauccuguga

SEQ ID NO: 45748 - RNA, 18 nt, Homo sapiens
uauauguguuuuucacau

SEQ ID NO: 45749 - RNA, 13 nt, Homo sapiens
uauauuguuugcu

SEQ ID NO: 45750 - RNA, 14 nt, Homo sapiens
uauauuguuugcua

SEQ ID NO: 45751 - RNA, 12 nt, Homo sapiens
uauauuuccuua

SEQ ID NO: 45752 - RNA, 13 nt, Homo sapiens
uauauuuccuuau

SEQ ID NO: 45753 - RNA, 13 nt, Homo sapiens
uauauuugaaaua

SEQ ID NO: 45754 - RNA, 13 nt, Homo sapiens
uaucacuugucaa

SEQ ID NO: 45755 - RNA, 18 nt, Homo sapiens
uaucacuugucaauaaaa

SEQ ID NO: 45756 - RNA, 19 nt, Homo sapiens
uaucacuugucaauaaaau

SEQ ID NO: 45757 - RNA, 15 nt, Homo sapiens
uaucagcuacaauug

SEQ ID NO: 45758 - RNA, 14 nt, Homo sapiens
uaucaucaguauug

SEQ ID NO: 45759 - RNA, 14 nt, Homo sapiens
uaucccuacuguaa

SEQ ID NO: 45760 - RNA, 22 nt, Homo sapiens
uauccuaauaaaaaggugacca

SEQ ID NO: 45761 - RNA, 15 nt, Homo sapiens
uauccugugacuguc

SEQ ID NO: 45762 - RNA, 14 nt, Homo sapiens
uaucgccaucacag

SEQ ID NO: 45763 - RNA, 20 nt, Homo sapiens
uaucuaauauauaugaauaa

SEQ ID NO: 45764 - RNA, 16 nt, Homo sapiens
uaucuagauacuguau

SEQ ID NO: 45765 - RNA, 22 nt, Homo sapiens
uaucucaggggccaacuaggca

SEQ ID NO: 45766 - RNA, 23 nt, Homo sapiens
uaucucaggggccaacuaggcag

SEQ ID NO: 45767 - RNA, 14 nt, Homo sapiens
uaucucauuuccaa

SEQ ID NO: 45768 - RNA, 11 nt, Homo sapiens
uaucugcuaug

SEQ ID NO: 45769 - RNA, 15 nt, Homo sapiens
uaucuuaguugguau

SEQ ID NO: 45770 - RNA, 14 nt, Homo sapiens
uaucuucacuuuua

SEQ ID NO: 45771 - RNA, 17 nt, Homo sapiens
uaucuuguuuuuccacu

SEQ ID NO: 45772 - RNA, 14 nt, Homo sapiens
uaugaaaaugucau

SEQ ID NO: 45773 - RNA, 12 nt, Homo sapiens
uaugaaauauua

SEQ ID NO: 45774 - RNA, 14 nt, Homo sapiens
uaugacacaucucu

SEQ ID NO: 45775 - RNA, 18 nt, Homo sapiens
uaugacgugacuggccug

SEQ ID NO: 45776 - RNA, 16 nt, Homo sapiens
uaugagaaucagauca

SEQ ID NO: 45777 - RNA, 22 nt, Homo sapiens
uaugagauguagcaaauuccaa

SEQ ID NO: 45778 - RNA, 14 nt, Homo sapiens
uaugaggcauuugu

SEQ ID NO: 45779 - RNA, 20 nt, Homo sapiens
uaugcaugaaguaauaugca

SEQ ID NO: 45780 - RNA, 22 nt, Homo sapiens
uaugcaugaaguaauaugcaca

SEQ ID NO: 45781 - RNA, 13 nt, Homo sapiens
uaugccccauuca

SEQ ID NO: 45782 - RNA, 14 nt, Homo sapiens
uaugccccauucaa

SEQ ID NO: 45783 - RNA, 17 nt, Homo sapiens
uaugccccauucaacau

SEQ ID NO: 45784 - RNA, 14 nt, Homo sapiens
uaugcuauuuauua

SEQ ID NO: 45785 - RNA, 15 nt, Homo sapiens
uaugcuucuguuuua

SEQ ID NO: 45786 - RNA, 21 nt, Homo sapiens
uauggcuauaggugcuacaaa

SEQ ID NO: 45787 - RNA, 18 nt, Homo sapiens
uauggcuuuugugcauua

SEQ ID NO: 45788 - RNA, 21 nt, Homo sapiens
uauguaaauagaaacguguau

SEQ ID NO: 45789 - RNA, 14 nt, Homo sapiens
uauguaaauagcua

SEQ ID NO: 45790 - RNA, 21 nt, Homo sapiens
uauguagaauauauuuccuua

SEQ ID NO: 45791 - RNA, 14 nt, Homo sapiens
uaugugcauauuuu

SEQ ID NO: 45792 - RNA, 18 nt, Homo sapiens
uaugugcauuuaauuaga

SEQ ID NO: 45793 - RNA, 14 nt, Homo sapiens
uauguggcuguauc

SEQ ID NO: 45794 - RNA, 16 nt, Homo sapiens
uauguuaaaacuggga

SEQ ID NO: 45795 - RNA, 22 nt, Homo sapiens
uauguuaauauuuuauguguaa

SEQ ID NO: 45796 - RNA, 18 nt, Homo sapiens
uauguuagagaauuuccu

SEQ ID NO: 45797 - RNA, 19 nt, Homo sapiens
uauguuagagaauuuccuu

SEQ ID NO: 45798 - RNA, 20 nt, Homo sapiens
uauguuagagaauuuccuua

SEQ ID NO: 45799 - RNA, 19 nt, Homo sapiens
uauguucuaagaagugaaa

SEQ ID NO: 45800 - RNA, 22 nt, Homo sapiens
uauuaaagaucugcaacuacua

SEQ ID NO: 45801 - RNA, 17 nt, Homo sapiens
uauuaaguauuuuauua

SEQ ID NO: 45802 - RNA, 11 nt, Homo sapiens
uauuacaucuu

SEQ ID NO: 45803 - RNA, 16 nt, Homo sapiens
uauuacaucuuucaca

SEQ ID NO: 45804 - RNA, 14 nt, Homo sapiens
uauuacgugcaaua

SEQ ID NO: 45805 - RNA, 19 nt, Homo sapiens
uauuagugaaguaugcacu

SEQ ID NO: 45806 - RNA, 20 nt, Homo sapiens
uauuagugaaguaugcacua

SEQ ID NO: 45807 - RNA, 21 nt, Homo sapiens
uauucacaaccacucauucaa

SEQ ID NO: 45808 - RNA, 19 nt, Homo sapiens
uauucagccccgggagugg

SEQ ID NO: 45809 - RNA, 23 nt, Homo sapiens
uauucagccccgggaguggcgcg

SEQ ID NO: 45810 - RNA, 16 nt, Homo sapiens
uauucucuccuguacc

SEQ ID NO: 45811 - RNA, 23 nt, Homo sapiens
uauugauaauaaaauucauucca

SEQ ID NO: 45812 - RNA, 21 nt, Homo sapiens
uauugauuuccguuaaaauac

SEQ ID NO: 45813 - RNA, 19 nt, Homo sapiens
uauugucuagugaaacucg

SEQ ID NO: 45814 - RNA, 20 nt, Homo sapiens
uauuguuuaaaaucauuucu

SEQ ID NO: 45815 - RNA, 19 nt, Homo sapiens
uauuuaauagguuuggaca

SEQ ID NO: 45816 - RNA, 17 nt, Homo sapiens
uauuuacggaacucaaa

SEQ ID NO: 45817 - RNA, 21 nt, Homo sapiens
uauuuauaauuccuauauccu

SEQ ID NO: 45818 - RNA, 19 nt, Homo sapiens
uauuuauugagcaccugca

SEQ ID NO: 45819 - RNA, 20 nt, Homo sapiens
uauuuauugauguuuucaca

SEQ ID NO: 45820 - RNA, 15 nt, Homo sapiens
uauuuauugcugaau

SEQ ID NO: 45821 - RNA, 15 nt, Homo sapiens
uauuuauuuauucau

SEQ ID NO: 45822 - RNA, 13 nt, Homo sapiens
uauuuauuuauuu

SEQ ID NO: 45823 - RNA, 16 nt, Homo sapiens
uauuuauuuuaauaau

SEQ ID NO: 45824 - RNA, 15 nt, Homo sapiens
uauuucacuugauga

SEQ ID NO: 45825 - RNA, 23 nt, Homo sapiens
uauuuccaagaaauauuccuuaa

SEQ ID NO: 45826 - RNA, 17 nt, Homo sapiens
uauuugcaagacauaga

SEQ ID NO: 45827 - RNA, 14 nt, Homo sapiens
uauuuguaucacaa

SEQ ID NO: 45828 - RNA, 16 nt, Homo sapiens
uauuuuagguguaaaa

SEQ ID NO: 45829 - RNA, 17 nt, Homo sapiens
uauuuuauaucaauuua

SEQ ID NO: 45830 - RNA, 16 nt, Homo sapiens
uauuuuaucugcuaug

SEQ ID NO: 45831 - RNA, 17 nt, Homo sapiens
uauuuucaugcuguuca

SEQ ID NO: 45832 - RNA, 12 nt, Homo sapiens
uauuuugaacaa

SEQ ID NO: 45833 - RNA, 12 nt, Homo sapiens
uauuuuguuuca

SEQ ID NO: 45834 - RNA, 14 nt, Homo sapiens
uauuuuuaaacugu

SEQ ID NO: 45835 - RNA, 22 nt, Homo sapiens
uauuuuuuaugaaacauuacag

SEQ ID NO: 45836 - RNA, 13 nt, Homo sapiens
uauuuuuuucuuu

SEQ ID NO: 45837 - RNA, 18 nt, Homo sapiens
uauuuuuuucuuuucuuu

SEQ ID NO: 45838 - RNA, 15 nt, Homo sapiens
uauuuuuuuuuuuaa

SEQ ID NO: 45839 - RNA, 20 nt, Homo sapiens
ucaaaacuucagacauagaa

SEQ ID NO: 45840 - RNA, 15 nt, Homo sapiens
ucaaagauagggagg

SEQ ID NO: 45841 - RNA, 15 nt, Homo sapiens
ucaaauccuugaaga

SEQ ID NO: 45842 - RNA, 12 nt, Homo sapiens
ucaaauguucuc

SEQ ID NO: 45843 - RNA, 16 nt, Homo sapiens
ucaaauguuguucucu

SEQ ID NO: 45844 - RNA, 23 nt, Homo sapiens
ucaacaagagacuggaaggacca

SEQ ID NO: 45845 - RNA, 14 nt, Homo sapiens
ucaaccaccuuuca

SEQ ID NO: 45846 - RNA, 15 nt, Homo sapiens
ucaacucauauuuuc

SEQ ID NO: 45847 - RNA, 16 nt, Homo sapiens
ucaacucauauuuuca

SEQ ID NO: 45848 - RNA, 10 nt, Homo sapiens
ucaagccagc

SEQ ID NO: 45849 - RNA, 11 nt, Homo sapiens
ucaagccagcc

SEQ ID NO: 45850 - RNA, 12 nt, Homo sapiens
ucaagccugccu

SEQ ID NO: 45851 - RNA, 19 nt, Homo sapiens
ucaaggcuuagacccucau

SEQ ID NO: 45852 - RNA, 23 nt, Homo sapiens
ucaaggcuuagacccucaugcug

SEQ ID NO: 45853 - RNA, 15 nt, Homo sapiens
ucaaguucaccagac

SEQ ID NO: 45854 - RNA, 21 nt, Homo sapiens
ucaauaaaacuuuuccaauga

SEQ ID NO: 45855 - RNA, 24 nt, Homo sapiens
ucaauauuuauuauuuucaccugu

SEQ ID NO: 45856 - RNA, 17 nt, Homo sapiens
ucaaucuggauucauau

SEQ ID NO: 45857 - RNA, 17 nt, Homo sapiens
ucaaugaaugaaugaau

SEQ ID NO: 45858 - RNA, 12 nt, Homo sapiens
ucaaugcagccc

SEQ ID NO: 45859 - RNA, 13 nt, Homo sapiens
ucaaugcagcccc

SEQ ID NO: 45860 - RNA, 15 nt, Homo sapiens
ucaaugccccugaau

SEQ ID NO: 45861 - RNA, 16 nt, Homo sapiens
ucaaugccccugaauu

SEQ ID NO: 45862 - RNA, 17 nt, Homo sapiens
ucaauguuuagcagauu

SEQ ID NO: 45863 - RNA, 20 nt, Homo sapiens
ucaauguuuagcagauuuaa

SEQ ID NO: 45864 - RNA, 15 nt, Homo sapiens
ucaauuccucuggga

SEQ ID NO: 45865 - RNA, 21 nt, Homo sapiens
ucaauuuaaaaaaaaaccuga

SEQ ID NO: 45866 - RNA, 17 nt, Homo sapiens
ucaauuuggcagugaua

SEQ ID NO: 45867 - RNA, 16 nt, Homo sapiens
ucacaaacucauccau

SEQ ID NO: 45868 - RNA, 16 nt, Homo sapiens
ucacaagacccaaaag

SEQ ID NO: 45869 - RNA, 13 nt, Homo sapiens
ucacaagcacuuu

SEQ ID NO: 45870 - RNA, 21 nt, Homo sapiens
ucacaagugaaaaacauccag

SEQ ID NO: 45871 - RNA, 14 nt, Homo sapiens
ucacagauaccucu

SEQ ID NO: 45872 - RNA, 21 nt, Homo sapiens
ucacagcuacuugggaggcug

SEQ ID NO: 45873 - RNA, 23 nt, Homo sapiens
ucacaggaaguagaggaggccac

SEQ ID NO: 45874 - RNA, 17 nt, Homo sapiens
ucacaggggacaggaug

SEQ ID NO: 45875 - RNA, 21 nt, Homo sapiens
ucacauacaauuauuuuuaca

SEQ ID NO: 45876 - RNA, 14 nt, Homo sapiens
ucacauccuguguu

SEQ ID NO: 45877 - RNA, 17 nt, Homo sapiens
ucacauuccaagccuca

SEQ ID NO: 45878 - RNA, 13 nt, Homo sapiens
ucaccaaggcuga

SEQ ID NO: 45879 - RNA, 22 nt, Homo sapiens
ucaccaucaauuuuaguuguca

SEQ ID NO: 45880 - RNA, 20 nt, Homo sapiens
ucaccucauggaauuggagc

SEQ ID NO: 45881 - RNA, 22 nt, Homo sapiens
ucaccucauggaauuggagcuc

SEQ ID NO: 45882 - RNA, 15 nt, Homo sapiens
ucaccucucaccucc

SEQ ID NO: 45883 - RNA, 8 nt, Homo sapiens
ucaccugu

SEQ ID NO: 45884 - RNA, 9 nt, Homo sapiens
ucaccuguu

SEQ ID NO: 45885 - RNA, 16 nt, Homo sapiens
ucacguaaagcuagaa

SEQ ID NO: 45886 - RNA, 16 nt, Homo sapiens
ucacuaguuguaauuu

SEQ ID NO: 45887 - RNA, 17 nt, Homo sapiens
ucacuaguuguaauuuu

SEQ ID NO: 45888 - RNA, 14 nt, Homo sapiens
ucacuccacuugga

SEQ ID NO: 45889 - RNA, 16 nt, Homo sapiens
ucacugcuuaacuuca

SEQ ID NO: 45890 - RNA, 19 nt, Homo sapiens
ucacugguggcuguuccug

SEQ ID NO: 45891 - RNA, 15 nt, Homo sapiens
ucacuuaauccuuug

SEQ ID NO: 45892 - RNA, 12 nt, Homo sapiens
ucacuugaugau

SEQ ID NO: 45893 - RNA, 19 nt, Homo sapiens
ucacuugucaauaaaaucc

SEQ ID NO: 45894 - RNA, 13 nt, Homo sapiens
ucacuuuacuguc

SEQ ID NO: 45895 - RNA, 22 nt, Homo sapiens
ucacuuuacuguccccaucauc

SEQ ID NO: 45896 - RNA, 18 nt, Homo sapiens
ucacuuuuuuucuuuucu

SEQ ID NO: 45897 - RNA, 13 nt, Homo sapiens
ucagaagaaauuc

SEQ ID NO: 45898 - RNA, 15 nt, Homo sapiens
ucagaagaccugguc

SEQ ID NO: 45899 - RNA, 18 nt, Homo sapiens
ucagaaggcaaaugacuu

SEQ ID NO: 45900 - RNA, 15 nt, Homo sapiens
ucagacagaacuuga

SEQ ID NO: 45901 - RNA, 17 nt, Homo sapiens
ucagacauagaauuaac

SEQ ID NO: 45902 - RNA, 20 nt, Homo sapiens
ucagaccuagaauaauacua

SEQ ID NO: 45903 - RNA, 17 nt, Homo sapiens
ucagaucauuucaaaac

SEQ ID NO: 45904 - RNA, 15 nt, Homo sapiens
ucagaucucuaacuu

SEQ ID NO: 45905 - RNA, 17 nt, Homo sapiens
ucagaucucuaacuuca

SEQ ID NO: 45906 - RNA, 16 nt, Homo sapiens
ucagcaccuacagugu

SEQ ID NO: 45907 - RNA, 14 nt, Homo sapiens
ucagccacugugau

SEQ ID NO: 45908 - RNA, 22 nt, Homo sapiens
ucagccagcccucuucugacac

SEQ ID NO: 45909 - RNA, 18 nt, Homo sapiens
ucagccccgggaguggcg

SEQ ID NO: 45910 - RNA, 14 nt, Homo sapiens
ucagcgguuuauau

SEQ ID NO: 45911 - RNA, 23 nt, Homo sapiens
ucagcucucaguugcagcccugc

SEQ ID NO: 45912 - RNA, 17 nt, Homo sapiens
ucagcugccuccccagc

SEQ ID NO: 45913 - RNA, 20 nt, Homo sapiens
ucagcugccuccccagcucu

SEQ ID NO: 45914 - RNA, 21 nt, Homo sapiens
ucagcugccuccccagcucua

SEQ ID NO: 45915 - RNA, 20 nt, Homo sapiens
ucaggaaaucaaauaugcaa

SEQ ID NO: 45916 - RNA, 22 nt, Homo sapiens
ucaggagauuucaugccuggug

SEQ ID NO: 45917 - RNA, 12 nt, Homo sapiens
ucaggaugccca

SEQ ID NO: 45918 - RNA, 21 nt, Homo sapiens
ucaggcuggccaacgggguga

SEQ ID NO: 45919 - RNA, 19 nt, Homo sapiens
ucaggugacccugaugaaa

SEQ ID NO: 45920 - RNA, 15 nt, Homo sapiens
ucaggugugcccuga

SEQ ID NO: 45921 - RNA, 17 nt, Homo sapiens
ucaguccaaagggcaug

SEQ ID NO: 45922 - RNA, 16 nt, Homo sapiens
ucaguccaugaagaug

SEQ ID NO: 45923 - RNA, 17 nt, Homo sapiens
ucaguccucuuucaaag

SEQ ID NO: 45924 - RNA, 18 nt, Homo sapiens
ucaguccucuuucaaagg

SEQ ID NO: 45925 - RNA, 18 nt, Homo sapiens
ucagugucaaugcagccc

SEQ ID NO: 45926 - RNA, 15 nt, Homo sapiens
ucaguguccucaucu

SEQ ID NO: 45927 - RNA, 13 nt, Homo sapiens
ucaguuacucuga

SEQ ID NO: 45928 - RNA, 14 nt, Homo sapiens
ucauacauguuaca

SEQ ID NO: 45929 - RNA, 16 nt, Homo sapiens
ucauaccuaucaucuu

SEQ ID NO: 45930 - RNA, 10 nt, Homo sapiens
ucauauugau

SEQ ID NO: 45931 - RNA, 20 nt, Homo sapiens
ucauauugaugugugucuag

SEQ ID NO: 45932 - RNA, 15 nt, Homo sapiens
ucaucaaucaaauaa

SEQ ID NO: 45933 - RNA, 12 nt, Homo sapiens
ucaucaaugaau

SEQ ID NO: 45934 - RNA, 20 nt, Homo sapiens
ucaucaaugaaugaaugaau

SEQ ID NO: 45935 - RNA, 22 nt, Homo sapiens
ucaucaguauugaagcauuuua

SEQ ID NO: 45936 - RNA, 19 nt, Homo sapiens
ucaucauaauaaauaucua

SEQ ID NO: 45937 - RNA, 13 nt, Homo sapiens
ucauccacuuucc

SEQ ID NO: 45938 - RNA, 14 nt, Homo sapiens
ucaucccacccgcc

SEQ ID NO: 45939 - RNA, 15 nt, Homo sapiens
ucaucccacccgccc

SEQ ID NO: 45940 - RNA, 18 nt, Homo sapiens
ucaucccacccgcccacc

SEQ ID NO: 45941 - RNA, 18 nt, Homo sapiens
ucaugaaggggcggcggc

SEQ ID NO: 45942 - RNA, 16 nt, Homo sapiens
ucaugaauuaguuuua

SEQ ID NO: 45943 - RNA, 13 nt, Homo sapiens
ucaugcauuugca

SEQ ID NO: 45944 - RNA, 13 nt, Homo sapiens
ucauggaauugga

SEQ ID NO: 45945 - RNA, 15 nt, Homo sapiens
ucauguacauccaug

SEQ ID NO: 45946 - RNA, 17 nt, Homo sapiens
ucauguacauccauggu

SEQ ID NO: 45947 - RNA, 13 nt, Homo sapiens
ucauguugaaacu

SEQ ID NO: 45948 - RNA, 23 nt, Homo sapiens
ucauguuuuugcuuuucaacaca

SEQ ID NO: 45949 - RNA, 17 nt, Homo sapiens
ucauuaaaguucuagug

SEQ ID NO: 45950 - RNA, 13 nt, Homo sapiens
ucauuaguuuuga

SEQ ID NO: 45951 - RNA, 14 nt, Homo sapiens
ucauuaguuuugaa

SEQ ID NO: 45952 - RNA, 17 nt, Homo sapiens
ucauuaucaguccaaag

SEQ ID NO: 45953 - RNA, 11 nt, Homo sapiens
ucauuaucuca

SEQ ID NO: 45954 - RNA, 17 nt, Homo sapiens
ucauuauguuaauauuu

SEQ ID NO: 45955 - RNA, 18 nt, Homo sapiens
ucauucuugaaagcugug

SEQ ID NO: 45956 - RNA, 14 nt, Homo sapiens
ucauucuuuuugaa

SEQ ID NO: 45957 - RNA, 16 nt, Homo sapiens
ucauucuuuuugaaau

SEQ ID NO: 45958 - RNA, 18 nt, Homo sapiens
ucauucuuuuugaaaugu

SEQ ID NO: 45959 - RNA, 12 nt, Homo sapiens
ucauuguucuau

SEQ ID NO: 45960 - RNA, 17 nt, Homo sapiens
ucauuguucuugugaac

SEQ ID NO: 45961 - RNA, 22 nt, Homo sapiens
ucauuuacuuuuaaacuuugau

SEQ ID NO: 45962 - RNA, 11 nt, Homo sapiens
ucauuucaaaa

SEQ ID NO: 45963 - RNA, 13 nt, Homo sapiens
ucauuuguuaaua

SEQ ID NO: 45964 - RNA, 19 nt, Homo sapiens
uccaaaggcuccugagaca

SEQ ID NO: 45965 - RNA, 21 nt, Homo sapiens
uccaaagggcauggguuuuau

SEQ ID NO: 45966 - RNA, 17 nt, Homo sapiens
uccaaaguacacuguuu

SEQ ID NO: 45967 - RNA, 19 nt, Homo sapiens
uccaaaguacacuguuuca

SEQ ID NO: 45968 - RNA, 17 nt, Homo sapiens
uccaaauauuguugaca

SEQ ID NO: 45969 - RNA, 13 nt, Homo sapiens
uccaaauucacaa

SEQ ID NO: 45970 - RNA, 21 nt, Homo sapiens
uccaagaucuuuuuccagguu

SEQ ID NO: 45971 - RNA, 18 nt, Homo sapiens
uccaagccucauguccac

SEQ ID NO: 45972 - RNA, 14 nt, Homo sapiens
uccaagccugacca

SEQ ID NO: 45973 - RNA, 23 nt, Homo sapiens
uccaagccugaccacgcuuucua

SEQ ID NO: 45974 - RNA, 18 nt, Homo sapiens
uccaauaaagaguuccuu

SEQ ID NO: 45975 - RNA, 14 nt, Homo sapiens
uccaauuaaggauu

SEQ ID NO: 45976 - RNA, 15 nt, Homo sapiens
uccaauuaaggauuu

SEQ ID NO: 45977 - RNA, 15 nt, Homo sapiens
uccaccuuacuucuu

SEQ ID NO: 45978 - RNA, 18 nt, Homo sapiens
uccaccuuacuucuucuc

SEQ ID NO: 45979 - RNA, 12 nt, Homo sapiens
uccacuacugcu

SEQ ID NO: 45980 - RNA, 14 nt, Homo sapiens
uccacuacugcuac

SEQ ID NO: 45981 - RNA, 22 nt, Homo sapiens
uccagaaauaaugaaauaacua

SEQ ID NO: 45982 - RNA, 14 nt, Homo sapiens
uccagccugagcga

SEQ ID NO: 45983 - RNA, 20 nt, Homo sapiens
uccagccugagcgacaguga

SEQ ID NO: 45984 - RNA, 12 nt, Homo sapiens
uccagccugggu

SEQ ID NO: 45985 - RNA, 11 nt, Homo sapiens
uccagcugccc

SEQ ID NO: 45986 - RNA, 13 nt, Homo sapiens
uccagcugccccg

SEQ ID NO: 45987 - RNA, 22 nt, Homo sapiens
uccagcugccccggggaggggc

SEQ ID NO: 45988 - RNA, 22 nt, Homo sapiens
uccagggcuacgcgcgcuccgc

SEQ ID NO: 45989 - RNA, 17 nt, Homo sapiens
uccagguuccugagccc

SEQ ID NO: 45990 - RNA, 17 nt, Homo sapiens
uccaguaguuagcuuuc

SEQ ID NO: 45991 - RNA, 21 nt, Homo sapiens
uccauuaaauauaaagcaaga

SEQ ID NO: 45992 - RNA, 16 nt, Homo sapiens
uccauucuuccuccca

SEQ ID NO: 45993 - RNA, 17 nt, Homo sapiens
ucccaaaacugauaccc

SEQ ID NO: 45994 - RNA, 13 nt, Homo sapiens
ucccaaagugcug

SEQ ID NO: 45995 - RNA, 16 nt, Homo sapiens
ucccaaagugcuggga

SEQ ID NO: 45996 - RNA, 21 nt, Homo sapiens
ucccaaagugcugggaauuac

SEQ ID NO: 45997 - RNA, 17 nt, Homo sapiens
ucccaaauuucauaccu

SEQ ID NO: 45998 - RNA, 14 nt, Homo sapiens
ucccaacuauaaaa

SEQ ID NO: 45999 - RNA, 21 nt, Homo sapiens
ucccacacuguccauucuucc

SEQ ID NO: 46000 - RNA, 19 nt, Homo sapiens
ucccagcacuuugggaggc

SEQ ID NO: 46001 - RNA, 19 nt, Homo sapiens
ucccagcgagggacaccga

SEQ ID NO: 46002 - RNA, 15 nt, Homo sapiens
ucccagcuacuuggg

SEQ ID NO: 46003 - RNA, 20 nt, Homo sapiens
ucccagcuacuugggaggcu

SEQ ID NO: 46004 - RNA, 15 nt, Homo sapiens
ucccauucaggaugc

SEQ ID NO: 46005 - RNA, 17 nt, Homo sapiens
ucccauucaggaugccc

SEQ ID NO: 46006 - RNA, 22 nt, Homo sapiens
ucccauucaggaugcccacggc

SEQ ID NO: 46007 - RNA, 23 nt, Homo sapiens
ucccauucaggaugcccacggcu

SEQ ID NO: 46008 - RNA, 17 nt, Homo sapiens
uccccaaaaagaauggg

SEQ ID NO: 46009 - RNA, 18 nt, Homo sapiens
uccccaaaaagaauggga

SEQ ID NO: 46010 - RNA, 16 nt, Homo sapiens
uccccaaccacuucau

SEQ ID NO: 46011 - RNA, 23 nt, Homo sapiens
uccccugucacgugugggcaaug

SEQ ID NO: 46012 - RNA, 16 nt, Homo sapiens
uccccuucccacacug

SEQ ID NO: 46013 - RNA, 16 nt, Homo sapiens
ucccgcuguuccucgc

SEQ ID NO: 46014 - RNA, 20 nt, Homo sapiens
ucccgcuguuccucgccacg

SEQ ID NO: 46015 - RNA, 11 nt, Homo sapiens
ucccggccgcg

SEQ ID NO: 46016 - RNA, 13 nt, Homo sapiens
ucccggccgcgcu

SEQ ID NO: 46017 - RNA, 18 nt, Homo sapiens
ucccggccgcgcugcgcg

SEQ ID NO: 46018 - RNA, 19 nt, Homo sapiens
ucccggccgcgcugcgcgc

SEQ ID NO: 46019 - RNA, 21 nt, Homo sapiens
ucccggccgcgcugcgcgccg

SEQ ID NO: 46020 - RNA, 22 nt, Homo sapiens
ucccggccgcgcugcgcgccgc

SEQ ID NO: 46021 - RNA, 13 nt, Homo sapiens
ucccggccggcgc

SEQ ID NO: 46022 - RNA, 14 nt, Homo sapiens
ucccggccggcgcg

SEQ ID NO: 46023 - RNA, 17 nt, Homo sapiens
ucccggccggcgcgcuc

SEQ ID NO: 46024 - RNA, 13 nt, Homo sapiens
ucccucuuggugc

SEQ ID NO: 46025 - RNA, 14 nt, Homo sapiens
ucccucuuggugcc

SEQ ID NO: 46026 - RNA, 12 nt, Homo sapiens
ucccugagcagg

SEQ ID NO: 46027 - RNA, 13 nt, Homo sapiens
ucccugccuggau

SEQ ID NO: 46028 - RNA, 16 nt, Homo sapiens
ucccugcugcccuucc

SEQ ID NO: 46029 - RNA, 14 nt, Homo sapiens
ucccuggccuuuca

SEQ ID NO: 46030 - RNA, 13 nt, Homo sapiens
ucccuuggacauu

SEQ ID NO: 46031 - RNA, 12 nt, Homo sapiens
ucccuuuuacau

SEQ ID NO: 46032 - RNA, 20 nt, Homo sapiens
ucccuuuuacauacugcugu

SEQ ID NO: 46033 - RNA, 21 nt, Homo sapiens
uccgcauccuccuccugcuuc

SEQ ID NO: 46034 - RNA, 21 nt, Homo sapiens
uccgcgcagcucaggcuggca

SEQ ID NO: 46035 - RNA, 13 nt, Homo sapiens
uccgcuacuucca

SEQ ID NO: 46036 - RNA, 19 nt, Homo sapiens
uccgcuacuuccagggcua

SEQ ID NO: 46037 - RNA, 13 nt, Homo sapiens
uccggacgcugcu

SEQ ID NO: 46038 - RNA, 14 nt, Homo sapiens
uccggacgcugcug

SEQ ID NO: 46039 - RNA, 17 nt, Homo sapiens
uccggacgcugcugccg

SEQ ID NO: 46040 - RNA, 13 nt, Homo sapiens
uccgggucgcagg

SEQ ID NO: 46041 - RNA, 21 nt, Homo sapiens
uccgggucgcaggaccauccc

SEQ ID NO: 46042 - RNA, 15 nt, Homo sapiens
uccgucaacucauau

SEQ ID NO: 46043 - RNA, 18 nt, Homo sapiens
uccguuaaaauaccagcc

SEQ ID NO: 46044 - RNA, 12 nt, Homo sapiens
uccuaacaggaa

SEQ ID NO: 46045 - RNA, 16 nt, Homo sapiens
uccuaagucccugcug

SEQ ID NO: 46046 - RNA, 21 nt, Homo sapiens
uccuaauaaaaaggugaccau

SEQ ID NO: 46047 - RNA, 12 nt, Homo sapiens
uccuagcgcagc

SEQ ID NO: 46048 - RNA, 13 nt, Homo sapiens
uccuagcgcagcc

SEQ ID NO: 46049 - RNA, 14 nt, Homo sapiens
uccuagcgcagcca

SEQ ID NO: 46050 - RNA, 20 nt, Homo sapiens
uccuagcgcagccaugugau

SEQ ID NO: 46051 - RNA, 22 nt, Homo sapiens
uccuagcgcagccaugugauua

SEQ ID NO: 46052 - RNA, 18 nt, Homo sapiens
uccuaggugagcagguga

SEQ ID NO: 46053 - RNA, 13 nt, Homo sapiens
uccuagucucuau

SEQ ID NO: 46054 - RNA, 19 nt, Homo sapiens
uccuagucucuaucauuaa

SEQ ID NO: 46055 - RNA, 23 nt, Homo sapiens
uccuagugaaagaggcagcuuga

SEQ ID NO: 46056 - RNA, 14 nt, Homo sapiens
uccuauauccugug

SEQ ID NO: 46057 - RNA, 16 nt, Homo sapiens
uccuauuauauucauu

SEQ ID NO: 46058 - RNA, 17 nt, Homo sapiens
uccuauuauauucauuc

SEQ ID NO: 46059 - RNA, 13 nt, Homo sapiens
uccucacuuugaa

SEQ ID NO: 46060 - RNA, 16 nt, Homo sapiens
uccucaucuguaaaau

SEQ ID NO: 46061 - RNA, 17 nt, Homo sapiens
uccucaucuguaaaaug

SEQ ID NO: 46062 - RNA, 18 nt, Homo sapiens
uccuccaugaauaucagu

SEQ ID NO: 46063 - RNA, 11 nt, Homo sapiens
uccucccggcc

SEQ ID NO: 46064 - RNA, 15 nt, Homo sapiens
uccucccggccgcgc

SEQ ID NO: 46065 - RNA, 17 nt, Homo sapiens
uccucccggccgcgcug

SEQ ID NO: 46066 - RNA, 20 nt, Homo sapiens
uccucccggccgcgcugcgc

SEQ ID NO: 46067 - RNA, 22 nt, Homo sapiens
uccuccgcugggccuggauggc

SEQ ID NO: 46068 - RNA, 20 nt, Homo sapiens
uccucgaggcccuagcauuu

SEQ ID NO: 46069 - RNA, 13 nt, Homo sapiens
uccucggacggcu

SEQ ID NO: 46070 - RNA, 23 nt, Homo sapiens
uccucucaaccaccuuucagaua

SEQ ID NO: 46071 - RNA, 23 nt, Homo sapiens
uccucuuucaaagguagccauca

SEQ ID NO: 46072 - RNA, 21 nt, Homo sapiens
uccugaaggaggcccugcccu

SEQ ID NO: 46073 - RNA, 22 nt, Homo sapiens
uccugaaggaggcccugcccuu

SEQ ID NO: 46074 - RNA, 15 nt, Homo sapiens
uccugagacacaugg

SEQ ID NO: 46075 - RNA, 16 nt, Homo sapiens
uccugagaccagccaa

SEQ ID NO: 46076 - RNA, 22 nt, Homo sapiens
uccugagaccagccaaccuggg

SEQ ID NO: 46077 - RNA, 22 nt, Homo sapiens
uccugauucauauuuaauuuga

SEQ ID NO: 46078 - RNA, 12 nt, Homo sapiens
uccugcaaugaa

SEQ ID NO: 46079 - RNA, 16 nt, Homo sapiens
uccugccccugagccc

SEQ ID NO: 46080 - RNA, 13 nt, Homo sapiens
uccuggacaguuu

SEQ ID NO: 46081 - RNA, 15 nt, Homo sapiens
uccuggauuccucac

SEQ ID NO: 46082 - RNA, 23 nt, Homo sapiens
uccuggcaaagaugaucaguaug

SEQ ID NO: 46083 - RNA, 21 nt, Homo sapiens
uccugguuccuaggugagcag

SEQ ID NO: 46084 - RNA, 21 nt, Homo sapiens
uccuguacuuuuuccagacac

SEQ ID NO: 46085 - RNA, 13 nt, Homo sapiens
uccugugacuguc

SEQ ID NO: 46086 - RNA, 13 nt, Homo sapiens
uccugugggaccu

SEQ ID NO: 46087 - RNA, 14 nt, Homo sapiens
uccuuacucuugau

SEQ ID NO: 46088 - RNA, 18 nt, Homo sapiens
uccuuagcccaucuuuca

SEQ ID NO: 46089 - RNA, 16 nt, Homo sapiens
uccuuauucagaauuu

SEQ ID NO: 46090 - RNA, 13 nt, Homo sapiens
uccuucagccuga

SEQ ID NO: 46091 - RNA, 22 nt, Homo sapiens
uccuucauggcaggcaucgcca

SEQ ID NO: 46092 - RNA, 13 nt, Homo sapiens
uccuuccuuauca

SEQ ID NO: 46093 - RNA, 20 nt, Homo sapiens
uccuuccuuaucacugacac

SEQ ID NO: 46094 - RNA, 17 nt, Homo sapiens
uccuugaagauuuacca

SEQ ID NO: 46095 - RNA, 11 nt, Homo sapiens
uccuugcugca

SEQ ID NO: 46096 - RNA, 13 nt, Homo sapiens
ucgaacugcugga

SEQ ID NO: 46097 - RNA, 12 nt, Homo sapiens
ucgaaucacuca

SEQ ID NO: 46098 - RNA, 18 nt, Homo sapiens
ucgcaggaccaucccggc

SEQ ID NO: 46099 - RNA, 19 nt, Homo sapiens
ucgcaggaccaucccggcc

SEQ ID NO: 46100 - RNA, 22 nt, Homo sapiens
ucgcaggaccaucccggccggc

SEQ ID NO: 46101 - RNA, 12 nt, Homo sapiens
ucgccacgcucu

SEQ ID NO: 46102 - RNA, 13 nt, Homo sapiens
ucgccacgcucug

SEQ ID NO: 46103 - RNA, 15 nt, Homo sapiens
ucgccacgcucuggg

SEQ ID NO: 46104 - RNA, 21 nt, Homo sapiens
ucgccacgcucugggucgccg

SEQ ID NO: 46105 - RNA, 22 nt, Homo sapiens
ucgccacgcucugggucgccgg

SEQ ID NO: 46106 - RNA, 16 nt, Homo sapiens
ucgccaucacagcuga

SEQ ID NO: 46107 - RNA, 17 nt, Homo sapiens
ucgccauucuugcugaa

SEQ ID NO: 46108 - RNA, 12 nt, Homo sapiens
ucgcccacuucc

SEQ ID NO: 46109 - RNA, 16 nt, Homo sapiens
ucgcccacuuccuccc

SEQ ID NO: 46110 - RNA, 20 nt, Homo sapiens
ucgcccacuuccucccggcc

SEQ ID NO: 46111 - RNA, 23 nt, Homo sapiens
ucgcccacuuccucccggccgcg

SEQ ID NO: 46112 - RNA, 14 nt, Homo sapiens
ucgcgcgccuccgc

SEQ ID NO: 46113 - RNA, 22 nt, Homo sapiens
ucgcugauauauguguuuuuca

SEQ ID NO: 46114 - RNA, 11 nt, Homo sapiens
ucgcuuccgca

SEQ ID NO: 46115 - RNA, 12 nt, Homo sapiens
ucgcuuccgcau

SEQ ID NO: 46116 - RNA, 13 nt, Homo sapiens
ucgcuuccgcauc

SEQ ID NO: 46117 - RNA, 14 nt, Homo sapiens
ucgcuuccgcaucc

SEQ ID NO: 46118 - RNA, 18 nt, Homo sapiens
ucgcuuccgcauccuagu

SEQ ID NO: 46119 - RNA, 12 nt, Homo sapiens
ucggacggcucc

SEQ ID NO: 46120 - RNA, 20 nt, Homo sapiens
ucggaucuggggcucuggga

SEQ ID NO: 46121 - RNA, 21 nt, Homo sapiens
ucggaucuggggcucugggau

SEQ ID NO: 46122 - RNA, 19 nt, Homo sapiens
ucgugguaggacuguagaa

SEQ ID NO: 46123 - RNA, 12 nt, Homo sapiens
ucuaaaaguuua

SEQ ID NO: 46124 - RNA, 18 nt, Homo sapiens
ucuaaaggcuaccuuugu

SEQ ID NO: 46125 - RNA, 15 nt, Homo sapiens
ucuaaguaaaaccac

SEQ ID NO: 46126 - RNA, 16 nt, Homo sapiens
ucuaaguaaaaccaca

SEQ ID NO: 46127 - RNA, 23 nt, Homo sapiens
ucuaauuuaucuugucucugggc

SEQ ID NO: 46128 - RNA, 24 nt, Homo sapiens
ucuaauuuaucuugucucugggcu

SEQ ID NO: 46129 - RNA, 12 nt, Homo sapiens
ucuacacuccag

SEQ ID NO: 46130 - RNA, 12 nt, Homo sapiens
ucuacauacuau

SEQ ID NO: 46131 - RNA, 15 nt, Homo sapiens
ucuacauacuaugga

SEQ ID NO: 46132 - RNA, 18 nt, Homo sapiens
ucuaggacugaauuauga

SEQ ID NO: 46133 - RNA, 12 nt, Homo sapiens
ucuaggccgggc

SEQ ID NO: 46134 - RNA, 12 nt, Homo sapiens
ucuagugagcag

SEQ ID NO: 46135 - RNA, 17 nt, Homo sapiens
ucuaguuugauuaaauu

SEQ ID NO: 46136 - RNA, 18 nt, Homo sapiens
ucuaguuugauuaaauuc

SEQ ID NO: 46137 - RNA, 16 nt, Homo sapiens
ucuaucauuaaaguuc

SEQ ID NO: 46138 - RNA, 18 nt, Homo sapiens
ucuaucauuaaaguucua

SEQ ID NO: 46139 - RNA, 14 nt, Homo sapiens
ucuaugacacaugc

SEQ ID NO: 46140 - RNA, 15 nt, Homo sapiens
ucuaugacacaugca

SEQ ID NO: 46141 - RNA, 17 nt, Homo sapiens
ucuauggcauauugaua

SEQ ID NO: 46142 - RNA, 14 nt, Homo sapiens
ucuauguggcugua

SEQ ID NO: 46143 - RNA, 11 nt, Homo sapiens
ucuauguuaau

SEQ ID NO: 46144 - RNA, 12 nt, Homo sapiens
ucuauguuaaua

SEQ ID NO: 46145 - RNA, 13 nt, Homo sapiens
ucuauuagcccuu

SEQ ID NO: 46146 - RNA, 21 nt, Homo sapiens
ucucaaaacugcacugucaag

SEQ ID NO: 46147 - RNA, 16 nt, Homo sapiens
ucucaaccaccuuuca

SEQ ID NO: 46148 - RNA, 21 nt, Homo sapiens
ucucaaccaccuuucagauaa

SEQ ID NO: 46149 - RNA, 12 nt, Homo sapiens
ucucaauauuuc

SEQ ID NO: 46150 - RNA, 13 nt, Homo sapiens
ucucaauauuuca

SEQ ID NO: 46151 - RNA, 22 nt, Homo sapiens
ucucaauguuuagcagauuuaa

SEQ ID NO: 46152 - RNA, 14 nt, Homo sapiens
ucucacaagcacuu

SEQ ID NO: 46153 - RNA, 20 nt, Homo sapiens
ucucaggggccaacuaggca

SEQ ID NO: 46154 - RNA, 15 nt, Homo sapiens
ucucauccacuuucc

SEQ ID NO: 46155 - RNA, 22 nt, Homo sapiens
ucuccaaaauaaaacuuuuuaa

SEQ ID NO: 46156 - RNA, 23 nt, Homo sapiens
ucuccaaaccacuuuuugcagcu

SEQ ID NO: 46157 - RNA, 13 nt, Homo sapiens
ucuccagccucag

SEQ ID NO: 46158 - RNA, 19 nt, Homo sapiens
ucuccaugaucccaccucc

SEQ ID NO: 46159 - RNA, 20 nt, Homo sapiens
ucuccccaugauguuuagaa

SEQ ID NO: 46160 - RNA, 15 nt, Homo sapiens
ucucgaacugcugga

SEQ ID NO: 46161 - RNA, 16 nt, Homo sapiens
ucucgaacugcuggau

SEQ ID NO: 46162 - RNA, 14 nt, Homo sapiens
ucucuaacucagaa

SEQ ID NO: 46163 - RNA, 16 nt, Homo sapiens
ucucuaacucagaaac

SEQ ID NO: 46164 - RNA, 20 nt, Homo sapiens
ucucuacuaaaaauacaaaa

SEQ ID NO: 46165 - RNA, 22 nt, Homo sapiens
ucucuaucauuaaaguucuagu

SEQ ID NO: 46166 - RNA, 23 nt, Homo sapiens
ucucuccucuccccaugauguuu

SEQ ID NO: 46167 - RNA, 19 nt, Homo sapiens
ucucugaccuccuccuuca

SEQ ID NO: 46168 - RNA, 16 nt, Homo sapiens
ucucuuauagaauauu

SEQ ID NO: 46169 - RNA, 19 nt, Homo sapiens
ucucuuuuuagagaaauuu

SEQ ID NO: 46170 - RNA, 20 nt, Homo sapiens
ucucuuuuuagagaaauuug

SEQ ID NO: 46171 - RNA, 23 nt, Homo sapiens
ucucuuuuuagagaaauuugcca

SEQ ID NO: 46172 - RNA, 13 nt, Homo sapiens
ucugaagaagaug

SEQ ID NO: 46173 - RNA, 22 nt, Homo sapiens
ucugaagaguggguuucacaag

SEQ ID NO: 46174 - RNA, 18 nt, Homo sapiens
ucugaaggguaauuauau

SEQ ID NO: 46175 - RNA, 16 nt, Homo sapiens
ucugaccuccuccuuc

SEQ ID NO: 46176 - RNA, 17 nt, Homo sapiens
ucugauaccucaacccc

SEQ ID NO: 46177 - RNA, 16 nt, Homo sapiens
ucugcaagcuuuucaa

SEQ ID NO: 46178 - RNA, 18 nt, Homo sapiens
ucugccuugguauagcau

SEQ ID NO: 46179 - RNA, 18 nt, Homo sapiens
ucugcuaugcuauugaag

SEQ ID NO: 46180 - RNA, 15 nt, Homo sapiens
ucugcuuuaauuuca

SEQ ID NO: 46181 - RNA, 13 nt, Homo sapiens
ucuggaaaccaca

SEQ ID NO: 46182 - RNA, 14 nt, Homo sapiens
ucuggaaaccacau

SEQ ID NO: 46183 - RNA, 21 nt, Homo sapiens
ucuggaaaccacauggcuuca

SEQ ID NO: 46184 - RNA, 21 nt, Homo sapiens
ucuggaagccucuauugccau

SEQ ID NO: 46185 - RNA, 17 nt, Homo sapiens
ucuggacuuuccagaga

SEQ ID NO: 46186 - RNA, 20 nt, Homo sapiens
ucuggacuuuccagagacca

SEQ ID NO: 46187 - RNA, 17 nt, Homo sapiens
ucuggcuaugcauuuga

SEQ ID NO: 46188 - RNA, 21 nt, Homo sapiens
ucugggauagcugacccagcc

SEQ ID NO: 46189 - RNA, 22 nt, Homo sapiens
ucugggauagcugacccagccc

SEQ ID NO: 46190 - RNA, 20 nt, Homo sapiens
ucugggcuuggggcuuccua

SEQ ID NO: 46191 - RNA, 16 nt, Homo sapiens
ucugggucucaguguc

SEQ ID NO: 46192 - RNA, 13 nt, Homo sapiens
ucuggugugaacu

SEQ ID NO: 46193 - RNA, 17 nt, Homo sapiens
ucuguugccaaggcugg

SEQ ID NO: 46194 - RNA, 18 nt, Homo sapiens
ucuuaaauaauaaagauc

SEQ ID NO: 46195 - RNA, 13 nt, Homo sapiens
ucuuaagacguga

SEQ ID NO: 46196 - RNA, 23 nt, Homo sapiens
ucuuaagacgugauuuugcugua

SEQ ID NO: 46197 - RNA, 14 nt, Homo sapiens
ucuuaauucuuagc

SEQ ID NO: 46198 - RNA, 19 nt, Homo sapiens
ucuuacaaugcauucugag

SEQ ID NO: 46199 - RNA, 19 nt, Homo sapiens
ucuuaguaugugcauuuaa

SEQ ID NO: 46200 - RNA, 21 nt, Homo sapiens
ucuuaguaugugcauuuaauu

SEQ ID NO: 46201 - RNA, 14 nt, Homo sapiens
ucuuaguugcugua

SEQ ID NO: 46202 - RNA, 18 nt, Homo sapiens
ucuuauaucuauauuuua

SEQ ID NO: 46203 - RNA, 21 nt, Homo sapiens
ucuuauccugucccuccucca

SEQ ID NO: 46204 - RNA, 20 nt, Homo sapiens
ucuuauuucauuucuuugag

SEQ ID NO: 46205 - RNA, 13 nt, Homo sapiens
ucuucacagucac

SEQ ID NO: 46206 - RNA, 14 nt, Homo sapiens
ucuuccucccugga

SEQ ID NO: 46207 - RNA, 16 nt, Homo sapiens
ucuuccucccuggaau

SEQ ID NO: 46208 - RNA, 20 nt, Homo sapiens
ucuucucauacuauuuaaga

SEQ ID NO: 46209 - RNA, 16 nt, Homo sapiens
ucuucugacacuaaaa

SEQ ID NO: 46210 - RNA, 21 nt, Homo sapiens
ucuucuuucaugaaggggcgg

SEQ ID NO: 46211 - RNA, 16 nt, Homo sapiens
ucuugauaaauggcuu

SEQ ID NO: 46212 - RNA, 17 nt, Homo sapiens
ucuugcaauucaauaca

SEQ ID NO: 46213 - RNA, 20 nt, Homo sapiens
ucuugggaauuuucuuccaa

SEQ ID NO: 46214 - RNA, 15 nt, Homo sapiens
ucuuggucacauaca

SEQ ID NO: 46215 - RNA, 17 nt, Homo sapiens
ucuuggucucaguguca

SEQ ID NO: 46216 - RNA, 12 nt, Homo sapiens
ucuuggugccuc

SEQ ID NO: 46217 - RNA, 19 nt, Homo sapiens
ucuuggugccucaguuucc

SEQ ID NO: 46218 - RNA, 14 nt, Homo sapiens
ucuugguucugaaa

SEQ ID NO: 46219 - RNA, 22 nt, Homo sapiens
ucuuguaaagguccuggcaaag

SEQ ID NO: 46220 - RNA, 21 nt, Homo sapiens
ucuuguaaggcauacugccuu

SEQ ID NO: 46221 - RNA, 21 nt, Homo sapiens
ucuugugaacccaaaguguga

SEQ ID NO: 46222 - RNA, 19 nt, Homo sapiens
ucuuucaagggaccucucc

SEQ ID NO: 46223 - RNA, 23 nt, Homo sapiens
ucuuucaugaaggggcggcggcc

SEQ ID NO: 46224 - RNA, 18 nt, Homo sapiens
ucuuuccacagaagcucc

SEQ ID NO: 46225 - RNA, 23 nt, Homo sapiens
ugaaaaaguauaaauaaaaugag

SEQ ID NO: 46226 - RNA, 18 nt, Homo sapiens
ugaaaacauagcaucuca

SEQ ID NO: 46227 - RNA, 19 nt, Homo sapiens
ugaaaagauuaugaucuca

SEQ ID NO: 46228 - RNA, 17 nt, Homo sapiens
ugaaaaucuacacucca

SEQ ID NO: 46229 - RNA, 17 nt, Homo sapiens
ugaaaaugucauuguuc

SEQ ID NO: 46230 - RNA, 16 nt, Homo sapiens
ugaaacauuacaguua

SEQ ID NO: 46231 - RNA, 18 nt, Homo sapiens
ugaaagaggcagcuugaa

SEQ ID NO: 46232 - RNA, 18 nt, Homo sapiens
ugaaagcagggacuugaa

SEQ ID NO: 46233 - RNA, 19 nt, Homo sapiens
ugaaagcagggacuugaac

SEQ ID NO: 46234 - RNA, 17 nt, Homo sapiens
ugaaaggcauucucuga

SEQ ID NO: 46235 - RNA, 17 nt, Homo sapiens
ugaaagucccagaucaa

SEQ ID NO: 46236 - RNA, 21 nt, Homo sapiens
ugaaauaagccagacaucaac

SEQ ID NO: 46237 - RNA, 13 nt, Homo sapiens
ugaaauagugucu

SEQ ID NO: 46238 - RNA, 17 nt, Homo sapiens
ugaaauauugacuuuuu

SEQ ID NO: 46239 - RNA, 19 nt, Homo sapiens
ugaaaugauuucacagugu

SEQ ID NO: 46240 - RNA, 19 nt, Homo sapiens
ugaacaaauuuacagagac

SEQ ID NO: 46241 - RNA, 23 nt, Homo sapiens
ugaacaaauuuacagagacagaa

SEQ ID NO: 46242 - RNA, 16 nt, Homo sapiens
ugaacacaaagccugu

SEQ ID NO: 46243 - RNA, 17 nt, Homo sapiens
ugaacaggauauucuca

SEQ ID NO: 46244 - RNA, 12 nt, Homo sapiens
ugaacauuccag

SEQ ID NO: 46245 - RNA, 16 nt, Homo sapiens
ugaacccgggaggcag

SEQ ID NO: 46246 - RNA, 20 nt, Homo sapiens
ugaaccguuugugauugcca

SEQ ID NO: 46247 - RNA, 21 nt, Homo sapiens
ugaaccguuugugauugccau

SEQ ID NO: 46248 - RNA, 16 nt, Homo sapiens
ugaacuaaacuuucac

SEQ ID NO: 46249 - RNA, 19 nt, Homo sapiens
ugaacuagaguuuagcugg

SEQ ID NO: 46250 - RNA, 13 nt, Homo sapiens
ugaagaaguugau

SEQ ID NO: 46251 - RNA, 14 nt, Homo sapiens
ugaagacaaugacu

SEQ ID NO: 46252 - RNA, 16 nt, Homo sapiens
ugaagauuuaauuacu

SEQ ID NO: 46253 - RNA, 21 nt, Homo sapiens
ugaagcacagugaucaaguua

SEQ ID NO: 46254 - RNA, 18 nt, Homo sapiens
ugaagcauuuuauaaauc

SEQ ID NO: 46255 - RNA, 21 nt, Homo sapiens
ugaagcuuuaagaacuaaaau

SEQ ID NO: 46256 - RNA, 19 nt, Homo sapiens
ugaaggaguccuugcauca

SEQ ID NO: 46257 - RNA, 16 nt, Homo sapiens
ugaaggggcggcggcc

SEQ ID NO: 46258 - RNA, 17 nt, Homo sapiens
ugaaggggcggcggccc

SEQ ID NO: 46259 - RNA, 18 nt, Homo sapiens
ugaaggggcggcggcccu

SEQ ID NO: 46260 - RNA, 19 nt, Homo sapiens
ugaagguagaauguuuuca

SEQ ID NO: 46261 - RNA, 14 nt, Homo sapiens
ugaaguaauaugca

SEQ ID NO: 46262 - RNA, 23 nt, Homo sapiens
ugaagugaaacugcuuguuuccu

SEQ ID NO: 46263 - RNA, 18 nt, Homo sapiens
ugaaguuuaauugacuua

SEQ ID NO: 46264 - RNA, 21 nt, Homo sapiens
ugaauaaaguguaaguucaca

SEQ ID NO: 46265 - RNA, 21 nt, Homo sapiens
ugaauaaauuuucuucuuggu

SEQ ID NO: 46266 - RNA, 14 nt, Homo sapiens
ugaauuaugaaacu

SEQ ID NO: 46267 - RNA, 15 nt, Homo sapiens
ugaauuaugaaacuu

SEQ ID NO: 46268 - RNA, 15 nt, Homo sapiens
ugaauucccugccug

SEQ ID NO: 46269 - RNA, 18 nt, Homo sapiens
ugaauucccugccuggau

SEQ ID NO: 46270 - RNA, 19 nt, Homo sapiens
ugaauucccugccuggauc

SEQ ID NO: 46271 - RNA, 22 nt, Homo sapiens
ugaauuuaaauagcuuuuuucu

SEQ ID NO: 46272 - RNA, 17 nt, Homo sapiens
ugacaacugugacugua

SEQ ID NO: 46273 - RNA, 22 nt, Homo sapiens
ugacaacugugacuguacccaa

SEQ ID NO: 46274 - RNA, 22 nt, Homo sapiens
ugacaaggggcaguggugguuu

SEQ ID NO: 46275 - RNA, 21 nt, Homo sapiens
ugacacuaaaacaccucagcu

SEQ ID NO: 46276 - RNA, 17 nt, Homo sapiens
ugacagcccaagggugg

SEQ ID NO: 46277 - RNA, 22 nt, Homo sapiens
ugacagcccaaggguggguggg

SEQ ID NO: 46278 - RNA, 23 nt, Homo sapiens
ugacagcccaagggugggugggg

SEQ ID NO: 46279 - RNA, 15 nt, Homo sapiens
ugacauaucacaugu

SEQ ID NO: 46280 - RNA, 19 nt, Homo sapiens
ugaccaauaaccaugccca

SEQ ID NO: 46281 - RNA, 19 nt, Homo sapiens
ugaccaauauuguacaguu

SEQ ID NO: 46282 - RNA, 17 nt, Homo sapiens
ugaccuccuccuucaug

SEQ ID NO: 46283 - RNA, 14 nt, Homo sapiens
ugacgugacuggcc

SEQ ID NO: 46284 - RNA, 19 nt, Homo sapiens
ugacuauuauagaauggaa

SEQ ID NO: 46285 - RNA, 12 nt, Homo sapiens
ugacucuuaaga

SEQ ID NO: 46286 - RNA, 21 nt, Homo sapiens
ugacuggccugcuggaugugg

SEQ ID NO: 46287 - RNA, 13 nt, Homo sapiens
ugacuuacuguac

SEQ ID NO: 46288 - RNA, 16 nt, Homo sapiens
ugacuuacuguacaug

SEQ ID NO: 46289 - RNA, 17 nt, Homo sapiens
ugacuuacuguacauga

SEQ ID NO: 46290 - RNA, 23 nt, Homo sapiens
ugagaaaccuuauuguaccucuc

SEQ ID NO: 46291 - RNA, 14 nt, Homo sapiens
ugagaacugcauau

SEQ ID NO: 46292 - RNA, 14 nt, Homo sapiens
ugagaagaaugacu

SEQ ID NO: 46293 - RNA, 13 nt, Homo sapiens
ugagacacauggg

SEQ ID NO: 46294 - RNA, 18 nt, Homo sapiens
ugagacacaugggugcua

SEQ ID NO: 46295 - RNA, 13 nt, Homo sapiens
ugagaccaaggcc

SEQ ID NO: 46296 - RNA, 13 nt, Homo sapiens
ugagaccagccaa

SEQ ID NO: 46297 - RNA, 17 nt, Homo sapiens
ugagacucugucucagu

SEQ ID NO: 46298 - RNA, 16 nt, Homo sapiens
ugagagacagcagguc

SEQ ID NO: 46299 - RNA, 18 nt, Homo sapiens
ugagagacagcaggucuc

SEQ ID NO: 46300 - RNA, 22 nt, Homo sapiens
ugagaugggagaaucacuugaa

SEQ ID NO: 46301 - RNA, 23 nt, Homo sapiens
ugagaugggagaaucacuugaac

SEQ ID NO: 46302 - RNA, 12 nt, Homo sapiens
ugagcaccugca

SEQ ID NO: 46303 - RNA, 19 nt, Homo sapiens
ugagcaccugcaggcguga

SEQ ID NO: 46304 - RNA, 19 nt, Homo sapiens
ugagcagucaggaaagaga

SEQ ID NO: 46305 - RNA, 23 nt, Homo sapiens
ugagcaucacaguuuugguugcu

SEQ ID NO: 46306 - RNA, 20 nt, Homo sapiens
ugagcaugccccugaaccau

SEQ ID NO: 46307 - RNA, 22 nt, Homo sapiens
ugagccaccaaacccggccuga

SEQ ID NO: 46308 - RNA, 21 nt, Homo sapiens
ugagccagugcuuuaauggca

SEQ ID NO: 46309 - RNA, 22 nt, Homo sapiens
ugagccagugcuuuaauggcau

SEQ ID NO: 46310 - RNA, 14 nt, Homo sapiens
ugagccuugaacuu

SEQ ID NO: 46311 - RNA, 15 nt, Homo sapiens
ugagccuuuguugcu

SEQ ID NO: 46312 - RNA, 20 nt, Homo sapiens
ugagccuuuguugcuaucaa

SEQ ID NO: 46313 - RNA, 14 nt, Homo sapiens
ugagcggaccuucc

SEQ ID NO: 46314 - RNA, 17 nt, Homo sapiens
ugagcggaccuucccag

SEQ ID NO: 46315 - RNA, 20 nt, Homo sapiens
ugagcggaccuucccagcua

SEQ ID NO: 46316 - RNA, 17 nt, Homo sapiens
ugaggaauauuugcaag

SEQ ID NO: 46317 - RNA, 19 nt, Homo sapiens
ugaggacuugggcgggaca

SEQ ID NO: 46318 - RNA, 17 nt, Homo sapiens
ugaggcauuugcagcug

SEQ ID NO: 46319 - RNA, 21 nt, Homo sapiens
ugaggcggguggaucacuuga

SEQ ID NO: 46320 - RNA, 22 nt, Homo sapiens
ugaggcuuuaaaacuuauccuc

SEQ ID NO: 46321 - RNA, 15 nt, Homo sapiens
ugagggcuugaggac

SEQ ID NO: 46322 - RNA, 12 nt, Homo sapiens
ugagguaaccuc

SEQ ID NO: 46323 - RNA, 16 nt, Homo sapiens
ugaguacguugugcau

SEQ ID NO: 46324 - RNA, 18 nt, Homo sapiens
ugagugccuguaaucaca

SEQ ID NO: 46325 - RNA, 19 nt, Homo sapiens
ugagugccuguaaucacag

SEQ ID NO: 46326 - RNA, 17 nt, Homo sapiens
ugaguggaugauguuuc

SEQ ID NO: 46327 - RNA, 22 nt, Homo sapiens
ugaguguugccuaauuuguuuu

SEQ ID NO: 46328 - RNA, 23 nt, Homo sapiens
ugauaaagaugagugagcaugcc

SEQ ID NO: 46329 - RNA, 13 nt, Homo sapiens
ugauaauuugcua

SEQ ID NO: 46330 - RNA, 12 nt, Homo sapiens
ugauacagaaaa

SEQ ID NO: 46331 - RNA, 16 nt, Homo sapiens
ugauagaggcuggcgg

SEQ ID NO: 46332 - RNA, 19 nt, Homo sapiens
ugauaugggucuugauaaa

SEQ ID NO: 46333 - RNA, 23 nt, Homo sapiens
ugauccugcaauuccacuuauag

SEQ ID NO: 46334 - RNA, 14 nt, Homo sapiens
ugaugaauguuaaa

SEQ ID NO: 46335 - RNA, 11 nt, Homo sapiens
ugaugcugagc

SEQ ID NO: 46336 - RNA, 13 nt, Homo sapiens
ugaugcugagccc

SEQ ID NO: 46337 - RNA, 17 nt, Homo sapiens
ugaugcugagcccggaa

SEQ ID NO: 46338 - RNA, 13 nt, Homo sapiens
ugauguuuuaagg

SEQ ID NO: 46339 - RNA, 15 nt, Homo sapiens
ugauuaaauucuugc

SEQ ID NO: 46340 - RNA, 12 nt, Homo sapiens
ugauuaaguaau

SEQ ID NO: 46341 - RNA, 17 nt, Homo sapiens
ugauuacaaggcuuuau

SEQ ID NO: 46342 - RNA, 13 nt, Homo sapiens
ugauucauauuua

SEQ ID NO: 46343 - RNA, 22 nt, Homo sapiens
ugauucauauuuaauuugaaga

SEQ ID NO: 46344 - RNA, 18 nt, Homo sapiens
ugauuccaccuacaugag

SEQ ID NO: 46345 - RNA, 22 nt, Homo sapiens
ugauucccuccugcuacucugu

SEQ ID NO: 46346 - RNA, 19 nt, Homo sapiens
ugauuuggggauauuuuuu

SEQ ID NO: 46347 - RNA, 20 nt, Homo sapiens
ugauuuggggauauuuuuuu

SEQ ID NO: 46348 - RNA, 14 nt, Homo sapiens
ugauuuuacaauug

SEQ ID NO: 46349 - RNA, 19 nt, Homo sapiens
ugauuuuauaugcuauuua

SEQ ID NO: 46350 - RNA, 15 nt, Homo sapiens
ugauuuuuguaauuu

SEQ ID NO: 46351 - RNA, 13 nt, Homo sapiens
ugcaaagcacuga

SEQ ID NO: 46352 - RNA, 12 nt, Homo sapiens
ugcaaauuguca

SEQ ID NO: 46353 - RNA, 13 nt, Homo sapiens
ugcaaauugucac

SEQ ID NO: 46354 - RNA, 14 nt, Homo sapiens
ugcaaauugucaca

SEQ ID NO: 46355 - RNA, 23 nt, Homo sapiens
ugcaacaugccagccacugugau

SEQ ID NO: 46356 - RNA, 17 nt, Homo sapiens
ugcaaccuccaccuucu

SEQ ID NO: 46357 - RNA, 12 nt, Homo sapiens
ugcaagacauag

SEQ ID NO: 46358 - RNA, 21 nt, Homo sapiens
ugcaagacauagaauaguguu

SEQ ID NO: 46359 - RNA, 19 nt, Homo sapiens
ugcaagcuuuucaaaauug

SEQ ID NO: 46360 - RNA, 22 nt, Homo sapiens
ugcaaucuucucagaaggcaaa

SEQ ID NO: 46361 - RNA, 23 nt, Homo sapiens
ugcacacauuuuuuaaaugcacc

SEQ ID NO: 46362 - RNA, 14 nt, Homo sapiens
ugcacacucuccca

SEQ ID NO: 46363 - RNA, 11 nt, Homo sapiens
ugcacaucaaa

SEQ ID NO: 46364 - RNA, 15 nt, Homo sapiens
ugcacaucuguuuug

SEQ ID NO: 46365 - RNA, 13 nt, Homo sapiens
ugcagacaugaga

SEQ ID NO: 46366 - RNA, 13 nt, Homo sapiens
ugcagauauucuc

SEQ ID NO: 46367 - RNA, 22 nt, Homo sapiens
ugcagcccccauuguggucaca

SEQ ID NO: 46368 - RNA, 17 nt, Homo sapiens
ugcagccccugggacca

SEQ ID NO: 46369 - RNA, 15 nt, Homo sapiens
ugcagcccugcugcu

SEQ ID NO: 46370 - RNA, 17 nt, Homo sapiens
ugcagcgaguacuuccc

SEQ ID NO: 46371 - RNA, 18 nt, Homo sapiens
ugcagcgaguacuucccg

SEQ ID NO: 46372 - RNA, 15 nt, Homo sapiens
ugcagcugugccaua

SEQ ID NO: 46373 - RNA, 11 nt, Homo sapiens
ugcaggcguga

SEQ ID NO: 46374 - RNA, 12 nt, Homo sapiens
ugcagugagccg

SEQ ID NO: 46375 - RNA, 13 nt, Homo sapiens
ugcagugagccga

SEQ ID NO: 46376 - RNA, 21 nt, Homo sapiens
ugcaguguuucccucuguguu

SEQ ID NO: 46377 - RNA, 15 nt, Homo sapiens
ugcaguucugaagaa

SEQ ID NO: 46378 - RNA, 17 nt, Homo sapiens
ugcaguucugaagaaga

SEQ ID NO: 46379 - RNA, 14 nt, Homo sapiens
ugcauacaaucuga

SEQ ID NO: 46380 - RNA, 14 nt, Homo sapiens
ugcauacaguaauu

SEQ ID NO: 46381 - RNA, 16 nt, Homo sapiens
ugcauauuuuauuaua

SEQ ID NO: 46382 - RNA, 20 nt, Homo sapiens
ugcauauuuuauuauaguca

SEQ ID NO: 46383 - RNA, 15 nt, Homo sapiens
ugcaucagcugcuga

SEQ ID NO: 46384 - RNA, 23 nt, Homo sapiens
ugcaugaaguaauaugcacacau

SEQ ID NO: 46385 - RNA, 13 nt, Homo sapiens
ugcauuauauuua

SEQ ID NO: 46386 - RNA, 16 nt, Homo sapiens
ugcauuauauuuauua

SEQ ID NO: 46387 - RNA, 20 nt, Homo sapiens
ugcauucugagguaaccuca

SEQ ID NO: 46388 - RNA, 14 nt, Homo sapiens
ugcauuuaauuaga

SEQ ID NO: 46389 - RNA, 17 nt, Homo sapiens
ugcauuuaauuuauuga

SEQ ID NO: 46390 - RNA, 13 nt, Homo sapiens
ugcauuugcacua

SEQ ID NO: 46391 - RNA, 14 nt, Homo sapiens
ugcauuugcacuau

SEQ ID NO: 46392 - RNA, 15 nt, Homo sapiens
ugcauuuggugguuu

SEQ ID NO: 46393 - RNA, 17 nt, Homo sapiens
ugccaaggcuggagugc

SEQ ID NO: 46394 - RNA, 13 nt, Homo sapiens
ugccaccuccugc

SEQ ID NO: 46395 - RNA, 14 nt, Homo sapiens
ugccauaauuacua

SEQ ID NO: 46396 - RNA, 15 nt, Homo sapiens
ugccaugagaguucu

SEQ ID NO: 46397 - RNA, 15 nt, Homo sapiens
ugccauuugagcucu

SEQ ID NO: 46398 - RNA, 15 nt, Homo sapiens
ugcccaagaaugaga

SEQ ID NO: 46399 - RNA, 22 nt, Homo sapiens
ugcccaagaaugagaagaauga

SEQ ID NO: 46400 - RNA, 16 nt, Homo sapiens
ugccccagggaccuuu

SEQ ID NO: 46401 - RNA, 11 nt, Homo sapiens
ugccccgggga

SEQ ID NO: 46402 - RNA, 13 nt, Homo sapiens
ugccccggggagg

SEQ ID NO: 46403 - RNA, 15 nt, Homo sapiens
ugccccggggagggg

SEQ ID NO: 46404 - RNA, 19 nt, Homo sapiens
ugccccggggaggggcgcu

SEQ ID NO: 46405 - RNA, 21 nt, Homo sapiens
ugccccggggaggggcgcucg

SEQ ID NO: 46406 - RNA, 16 nt, Homo sapiens
ugccccugcacuccag

SEQ ID NO: 46407 - RNA, 17 nt, Homo sapiens
ugccccugcacuccagc

SEQ ID NO: 46408 - RNA, 17 nt, Homo sapiens
ugcccuaaaguguauuu

SEQ ID NO: 46409 - RNA, 22 nt, Homo sapiens
ugcccugaaagucccagaucaa

SEQ ID NO: 46410 - RNA, 15 nt, Homo sapiens
ugcccuuacaggaac

SEQ ID NO: 46411 - RNA, 13 nt, Homo sapiens
ugcccuuccccuu

SEQ ID NO: 46412 - RNA, 20 nt, Homo sapiens
ugcccuuccccuucccacac

SEQ ID NO: 46413 - RNA, 19 nt, Homo sapiens
ugccgugggccugagacca

SEQ ID NO: 46414 - RNA, 16 nt, Homo sapiens
ugccuaagugcagccc

SEQ ID NO: 46415 - RNA, 17 nt, Homo sapiens
ugccuaagugcagcccc

SEQ ID NO: 46416 - RNA, 21 nt, Homo sapiens
ugccucaccucucaccuccca

SEQ ID NO: 46417 - RNA, 21 nt, Homo sapiens
ugccucagaaaacaaggauga

SEQ ID NO: 46418 - RNA, 13 nt, Homo sapiens
ugccuccccagcu

SEQ ID NO: 46419 - RNA, 16 nt, Homo sapiens
ugccuccccagcucua

SEQ ID NO: 46420 - RNA, 18 nt, Homo sapiens
ugccucucucauccacuu

SEQ ID NO: 46421 - RNA, 15 nt, Homo sapiens
ugccucuugcaauuc

SEQ ID NO: 46422 - RNA, 11 nt, Homo sapiens
ugccuggaucu

SEQ ID NO: 46423 - RNA, 22 nt, Homo sapiens
ugccuggaucucacaagcacuu

SEQ ID NO: 46424 - RNA, 14 nt, Homo sapiens
ugccuguaaucaca

SEQ ID NO: 46425 - RNA, 18 nt, Homo sapiens
ugccuugguauagcauau

SEQ ID NO: 46426 - RNA, 17 nt, Homo sapiens
ugccuuguuuaauguua

SEQ ID NO: 46427 - RNA, 15 nt, Homo sapiens
ugcgcgccgcgcucc

SEQ ID NO: 46428 - RNA, 16 nt, Homo sapiens
ugcgcgccgcgcuccu

SEQ ID NO: 46429 - RNA, 18 nt, Homo sapiens
ugcgcgccgcgcuccucg

SEQ ID NO: 46430 - RNA, 13 nt, Homo sapiens
ugcgcucggccug

SEQ ID NO: 46431 - RNA, 14 nt, Homo sapiens
ugcgcucggccugc

SEQ ID NO: 46432 - RNA, 16 nt, Homo sapiens
ugcgcucggccugcuc

SEQ ID NO: 46433 - RNA, 17 nt, Homo sapiens
ugcgcucggccugcucg

SEQ ID NO: 46434 - RNA, 13 nt, Homo sapiens
ugcuaagugaaau

SEQ ID NO: 46435 - RNA, 16 nt, Homo sapiens
ugcuacaaaaacacag

SEQ ID NO: 46436 - RNA, 18 nt, Homo sapiens
ugcuacaaaaacacagca

SEQ ID NO: 46437 - RNA, 16 nt, Homo sapiens
ugcuaguuuauauaga

SEQ ID NO: 46438 - RNA, 13 nt, Homo sapiens
ugcuaucaaucca

SEQ ID NO: 46439 - RNA, 16 nt, Homo sapiens
ugcuaucgccaucaca

SEQ ID NO: 46440 - RNA, 13 nt, Homo sapiens
ugcuaugcuauug

SEQ ID NO: 46441 - RNA, 14 nt, Homo sapiens
ugcuaugcuauuga

SEQ ID NO: 46442 - RNA, 18 nt, Homo sapiens
ugcucauggaauuggagc

SEQ ID NO: 46443 - RNA, 20 nt, Homo sapiens
ugcucauggaauuggagcuc

SEQ ID NO: 46444 - RNA, 20 nt, Homo sapiens
ugcuccuggcuggggccugu

SEQ ID NO: 46445 - RNA, 21 nt, Homo sapiens
ugcuccuggcuggggccuguu

SEQ ID NO: 46446 - RNA, 21 nt, Homo sapiens
ugcucgcccacuuccucccgg

SEQ ID NO: 46447 - RNA, 15 nt, Homo sapiens
ugcugaaacaacaaa

SEQ ID NO: 46448 - RNA, 13 nt, Homo sapiens
ugcugaaugacua

SEQ ID NO: 46449 - RNA, 13 nt, Homo sapiens
ugcugcaccugug

SEQ ID NO: 46450 - RNA, 12 nt, Homo sapiens
ugcugccguggg

SEQ ID NO: 46451 - RNA, 16 nt, Homo sapiens
ugcugccgugggccug

SEQ ID NO: 46452 - RNA, 19 nt, Homo sapiens
ugcugccgugggccugaga

SEQ ID NO: 46453 - RNA, 12 nt, Homo sapiens
ugcuggagcucu

SEQ ID NO: 46454 - RNA, 15 nt, Homo sapiens
ugcuggauucaagug

SEQ ID NO: 46455 - RNA, 12 nt, Homo sapiens
ugcuggccaggc

SEQ ID NO: 46456 - RNA, 18 nt, Homo sapiens
ugcuggccaggcuggucu

SEQ ID NO: 46457 - RNA, 19 nt, Homo sapiens
ugcuggccaggcuggucuc

SEQ ID NO: 46458 - RNA, 22 nt, Homo sapiens
ugcuggcuuaaaauguaauuaa

SEQ ID NO: 46459 - RNA, 13 nt, Homo sapiens
ugcugggaauuac

SEQ ID NO: 46460 - RNA, 20 nt, Homo sapiens
ugcugggaauuacaggcgug

SEQ ID NO: 46461 - RNA, 23 nt, Homo sapiens
ugcugggaauuacaggcgugagc

SEQ ID NO: 46462 - RNA, 13 nt, Homo sapiens
ugcugguggcgcu

SEQ ID NO: 46463 - RNA, 15 nt, Homo sapiens
ugcugguggcgcugg

SEQ ID NO: 46464 - RNA, 16 nt, Homo sapiens
ugcugguggcgcuggc

SEQ ID NO: 46465 - RNA, 20 nt, Homo sapiens
ugcugguggcgcuggcugcg

SEQ ID NO: 46466 - RNA, 21 nt, Homo sapiens
ugcuguagaagauggcacuua

SEQ ID NO: 46467 - RNA, 13 nt, Homo sapiens
ugcuguauuuuaa

SEQ ID NO: 46468 - RNA, 20 nt, Homo sapiens
ugcuguuuccuagcgcagcc

SEQ ID NO: 46469 - RNA, 16 nt, Homo sapiens
ugcuucuguuuuauaa

SEQ ID NO: 46470 - RNA, 12 nt, Homo sapiens
ugcuuggcccag

SEQ ID NO: 46471 - RNA, 13 nt, Homo sapiens
ugcuuggcccagg

SEQ ID NO: 46472 - RNA, 14 nt, Homo sapiens
ugcuuggcccagga

SEQ ID NO: 46473 - RNA, 12 nt, Homo sapiens
ugcuuguacaua

SEQ ID NO: 46474 - RNA, 13 nt, Homo sapiens
ugcuuugugauuu

SEQ ID NO: 46475 - RNA, 21 nt, Homo sapiens
uggaaaaaaaggaagaaauuc

SEQ ID NO: 46476 - RNA, 14 nt, Homo sapiens
uggaaaaugugcaa

SEQ ID NO: 46477 - RNA, 16 nt, Homo sapiens
uggaaaaugugcaaua

SEQ ID NO: 46478 - RNA, 22 nt, Homo sapiens
uggaaacaagucagucauucag

SEQ ID NO: 46479 - RNA, 14 nt, Homo sapiens
uggaaacguauuca

SEQ ID NO: 46480 - RNA, 15 nt, Homo sapiens
uggaaaggcagcucu

SEQ ID NO: 46481 - RNA, 19 nt, Homo sapiens
uggaaauaaaagauuguau

SEQ ID NO: 46482 - RNA, 14 nt, Homo sapiens
uggaacucaaggaa

SEQ ID NO: 46483 - RNA, 15 nt, Homo sapiens
uggaacucaaggaaa

SEQ ID NO: 46484 - RNA, 18 nt, Homo sapiens
uggaagccucuauugcca

SEQ ID NO: 46485 - RNA, 21 nt, Homo sapiens
uggaagccucuauugccauga

SEQ ID NO: 46486 - RNA, 14 nt, Homo sapiens
uggaaguaaauguu

SEQ ID NO: 46487 - RNA, 14 nt, Homo sapiens
uggaauacucuuau

SEQ ID NO: 46488 - RNA, 18 nt, Homo sapiens
uggaauauguaaauagaa

SEQ ID NO: 46489 - RNA, 17 nt, Homo sapiens
uggaaucauaugggaua

SEQ ID NO: 46490 - RNA, 13 nt, Homo sapiens
uggaaucuuguaa

SEQ ID NO: 46491 - RNA, 15 nt, Homo sapiens
uggacuuccauuugg

SEQ ID NO: 46492 - RNA, 17 nt, Homo sapiens
uggagaaaggacccuca

SEQ ID NO: 46493 - RNA, 11 nt, Homo sapiens
uggagacacca

SEQ ID NO: 46494 - RNA, 12 nt, Homo sapiens
uggagacaccac

SEQ ID NO: 46495 - RNA, 17 nt, Homo sapiens
uggagacaccaccaccc

SEQ ID NO: 46496 - RNA, 16 nt, Homo sapiens
uggagcuagaauuuga

SEQ ID NO: 46497 - RNA, 21 nt, Homo sapiens
uggagcucugcccauccugcc

SEQ ID NO: 46498 - RNA, 18 nt, Homo sapiens
uggagcugccucucucau

SEQ ID NO: 46499 - RNA, 18 nt, Homo sapiens
uggagugcaguggcgcaa

SEQ ID NO: 46500 - RNA, 18 nt, Homo sapiens
uggaucucacaagcacuu

SEQ ID NO: 46501 - RNA, 19 nt, Homo sapiens
uggaucucacaagcacuuu

SEQ ID NO: 46502 - RNA, 22 nt, Homo sapiens
uggauguggagggggcgcgugc

SEQ ID NO: 46503 - RNA, 13 nt, Homo sapiens
uggauucaaguga

SEQ ID NO: 46504 - RNA, 15 nt, Homo sapiens
uggauucaagugauc

SEQ ID NO: 46505 - RNA, 21 nt, Homo sapiens
uggauucaauuuuaaggcaua

SEQ ID NO: 46506 - RNA, 14 nt, Homo sapiens
uggauucauauuua

SEQ ID NO: 46507 - RNA, 23 nt, Homo sapiens
uggauugugccuaauguguuuga

SEQ ID NO: 46508 - RNA, 19 nt, Homo sapiens
uggcaaagaugaucaguau

SEQ ID NO: 46509 - RNA, 22 nt, Homo sapiens
uggcaaaucucuauuaggaaau

SEQ ID NO: 46510 - RNA, 19 nt, Homo sapiens
uggcacaguuuucugagaa

SEQ ID NO: 46511 - RNA, 14 nt, Homo sapiens
uggcacaucagcac

SEQ ID NO: 46512 - RNA, 23 nt, Homo sapiens
uggcaccgcuguacgcgagcgcg

SEQ ID NO: 46513 - RNA, 13 nt, Homo sapiens
uggcacuugggac

SEQ ID NO: 46514 - RNA, 14 nt, Homo sapiens
uggcacuugggaca

SEQ ID NO: 46515 - RNA, 16 nt, Homo sapiens
uggcacuugggacaaa

SEQ ID NO: 46516 - RNA, 17 nt, Homo sapiens
uggcaggaggcauccaa

SEQ ID NO: 46517 - RNA, 15 nt, Homo sapiens
uggccagaagucaag

SEQ ID NO: 46518 - RNA, 17 nt, Homo sapiens
uggccagaagucaaggc

SEQ ID NO: 46519 - RNA, 18 nt, Homo sapiens
uggccagaagucaaggcu

SEQ ID NO: 46520 - RNA, 20 nt, Homo sapiens
uggccagaagucaaggcuua

SEQ ID NO: 46521 - RNA, 23 nt, Homo sapiens
uggccagaagucaaggcuuagac

SEQ ID NO: 46522 - RNA, 15 nt, Homo sapiens
uggccaggcuggucu

SEQ ID NO: 46523 - RNA, 13 nt, Homo sapiens
uggccagugagau

SEQ ID NO: 46524 - RNA, 21 nt, Homo sapiens
uggccagugagaucaauguga

SEQ ID NO: 46525 - RNA, 17 nt, Homo sapiens
uggcccaggaguuuggc

SEQ ID NO: 46526 - RNA, 19 nt, Homo sapiens
uggcccaggaguuuggcca

SEQ ID NO: 46527 - RNA, 21 nt, Homo sapiens
uggcccaggaguuuggccaga

SEQ ID NO: 46528 - RNA, 22 nt, Homo sapiens
uggcccaggaguuuggccagaa

SEQ ID NO: 46529 - RNA, 22 nt, Homo sapiens
uggccuagcauacguacacauu

SEQ ID NO: 46530 - RNA, 11 nt, Homo sapiens
uggccugcugg

SEQ ID NO: 46531 - RNA, 12 nt, Homo sapiens
uggccugcugga

SEQ ID NO: 46532 - RNA, 13 nt, Homo sapiens
uggccugcuggau

SEQ ID NO: 46533 - RNA, 12 nt, Homo sapiens
uggcgcgcgcca

SEQ ID NO: 46534 - RNA, 16 nt, Homo sapiens
uggcgcgcgccaccac

SEQ ID NO: 46535 - RNA, 17 nt, Homo sapiens
uggcgcgcgccaccacg

SEQ ID NO: 46536 - RNA, 18 nt, Homo sapiens
uggcgcgcgccaccacgc

SEQ ID NO: 46537 - RNA, 21 nt, Homo sapiens
uggcgcgcgccaccacgccca

SEQ ID NO: 46538 - RNA, 15 nt, Homo sapiens
uggcgcuggcugcgc

SEQ ID NO: 46539 - RNA, 16 nt, Homo sapiens
uggcgcuggcugcgcu

SEQ ID NO: 46540 - RNA, 20 nt, Homo sapiens
uggcgcuggcugcgcucggc

SEQ ID NO: 46541 - RNA, 21 nt, Homo sapiens
uggcgcuggcugcgcucggcc

SEQ ID NO: 46542 - RNA, 23 nt, Homo sapiens
uggcguuguggggaugaacuuuu

SEQ ID NO: 46543 - RNA, 21 nt, Homo sapiens
uggcuaagcaaaaugugauau

SEQ ID NO: 46544 - RNA, 14 nt, Homo sapiens
uggcugcgcucggc

SEQ ID NO: 46545 - RNA, 15 nt, Homo sapiens
uggcugcgcucggcc

SEQ ID NO: 46546 - RNA, 15 nt, Homo sapiens
uggcugcugguggcg

SEQ ID NO: 46547 - RNA, 19 nt, Homo sapiens
uggcugcugguggcgcugg

SEQ ID NO: 46548 - RNA, 23 nt, Homo sapiens
uggcugcugguggcgcuggcugc

SEQ ID NO: 46549 - RNA, 22 nt, Homo sapiens
uggcuugccucuugcaauucaa

SEQ ID NO: 46550 - RNA, 16 nt, Homo sapiens
uggcuuuugugcauua

SEQ ID NO: 46551 - RNA, 14 nt, Homo sapiens
ugggaaagcauugu

SEQ ID NO: 46552 - RNA, 17 nt, Homo sapiens
ugggacaguuccugaga

SEQ ID NO: 46553 - RNA, 14 nt, Homo sapiens
ugggagaaucacuu

SEQ ID NO: 46554 - RNA, 18 nt, Homo sapiens
ugggagaaucacuugaac

SEQ ID NO: 46555 - RNA, 20 nt, Homo sapiens
ugggagaaucacuugaaccc

SEQ ID NO: 46556 - RNA, 19 nt, Homo sapiens
ugggagcuuuuguagaagu

SEQ ID NO: 46557 - RNA, 17 nt, Homo sapiens
ugggauagcugacccag

SEQ ID NO: 46558 - RNA, 10 nt, Homo sapiens
ugggcagguc

SEQ ID NO: 46559 - RNA, 11 nt, Homo sapiens
ugggcagguca

SEQ ID NO: 46560 - RNA, 12 nt, Homo sapiens
ugggcaggucac

SEQ ID NO: 46561 - RNA, 16 nt, Homo sapiens
ugggccugagaccaag

SEQ ID NO: 46562 - RNA, 17 nt, Homo sapiens
ugggccugagaccaagg

SEQ ID NO: 46563 - RNA, 15 nt, Homo sapiens
ugggcugagcaguca

SEQ ID NO: 46564 - RNA, 18 nt, Homo sapiens
uggggagccaacagaagc

SEQ ID NO: 46565 - RNA, 18 nt, Homo sapiens
uggggcagugcuuggccc

SEQ ID NO: 46566 - RNA, 19 nt, Homo sapiens
uggggcagugcuuggccca

SEQ ID NO: 46567 - RNA, 20 nt, Homo sapiens
uggggcagugcuuggcccag

SEQ ID NO: 46568 - RNA, 18 nt, Homo sapiens
uggggcugaugcaguugu

SEQ ID NO: 46569 - RNA, 13 nt, Homo sapiens
uggggugggggug

SEQ ID NO: 46570 - RNA, 15 nt, Homo sapiens
ugggguggguggggc

SEQ ID NO: 46571 - RNA, 16 nt, Homo sapiens
ugggguugggggggag

SEQ ID NO: 46572 - RNA, 11 nt, Homo sapiens
ugggucgccgg

SEQ ID NO: 46573 - RNA, 12 nt, Homo sapiens
ugggucgccggc

SEQ ID NO: 46574 - RNA, 15 nt, Homo sapiens
ugggucgccggcauc

SEQ ID NO: 46575 - RNA, 12 nt, Homo sapiens
uggguggggcag

SEQ ID NO: 46576 - RNA, 21 nt, Homo sapiens
uggguggggcagugcuuggcc

SEQ ID NO: 46577 - RNA, 14 nt, Homo sapiens
uggguggggugagg

SEQ ID NO: 46578 - RNA, 17 nt, Homo sapiens
uggguuguguguuuauu

SEQ ID NO: 46579 - RNA, 21 nt, Homo sapiens
ugguaguuuuacaguguuucu

SEQ ID NO: 46580 - RNA, 14 nt, Homo sapiens
uggucacauacaau

SEQ ID NO: 46581 - RNA, 18 nt, Homo sapiens
ugguccgaagucuuccau

SEQ ID NO: 46582 - RNA, 20 nt, Homo sapiens
uggucuaccuguucgcgcgc

SEQ ID NO: 46583 - RNA, 21 nt, Homo sapiens
uggucuaccuguucgcgcgcc

SEQ ID NO: 46584 - RNA, 12 nt, Homo sapiens
uggucucagugu

SEQ ID NO: 46585 - RNA, 18 nt, Homo sapiens
uggucuggagggaagccu

SEQ ID NO: 46586 - RNA, 13 nt, Homo sapiens
ugguggcgcuggc

SEQ ID NO: 46587 - RNA, 11 nt, Homo sapiens
uggugugauuu

SEQ ID NO: 46588 - RNA, 21 nt, Homo sapiens
ugguuauuuagggaacugcuu

SEQ ID NO: 46589 - RNA, 12 nt, Homo sapiens
uguaaaauaagg

SEQ ID NO: 46590 - RNA, 22 nt, Homo sapiens
uguaaagcuuugugcagauucu

SEQ ID NO: 46591 - RNA, 16 nt, Homo sapiens
uguaaauagcuaagau

SEQ ID NO: 46592 - RNA, 22 nt, Homo sapiens
uguaacuguaaagaugaauguc

SEQ ID NO: 46593 - RNA, 22 nt, Homo sapiens
uguaagacaaaaagcuacuuau

SEQ ID NO: 46594 - RNA, 21 nt, Homo sapiens
uguaaguaaacggucucucac

SEQ ID NO: 46595 - RNA, 22 nt, Homo sapiens
uguaaguuuaugcauacaguaa

SEQ ID NO: 46596 - RNA, 20 nt, Homo sapiens
uguaauagaaauaaaccuau

SEQ ID NO: 46597 - RNA, 19 nt, Homo sapiens
uguaaucccagcuacuugg

SEQ ID NO: 46598 - RNA, 18 nt, Homo sapiens
uguaauuugugauacaau

SEQ ID NO: 46599 - RNA, 14 nt, Homo sapiens
uguacagucuugua

SEQ ID NO: 46600 - RNA, 22 nt, Homo sapiens
uguacaguuuuuauugcuuguu

SEQ ID NO: 46601 - RNA, 18 nt, Homo sapiens
uguacauuuccaaauuca

SEQ ID NO: 46602 - RNA, 18 nt, Homo sapiens
uguagaagauggcacuua

SEQ ID NO: 46603 - RNA, 19 nt, Homo sapiens
uguagaauauauuuccuua

SEQ ID NO: 46604 - RNA, 19 nt, Homo sapiens
uguagauaaacucagaaau

SEQ ID NO: 46605 - RNA, 15 nt, Homo sapiens
uguagauaaagcacu

SEQ ID NO: 46606 - RNA, 16 nt, Homo sapiens
uguagcauccuggaau

SEQ ID NO: 46607 - RNA, 12 nt, Homo sapiens
uguagcucucug

SEQ ID NO: 46608 - RNA, 15 nt, Homo sapiens
uguaguguuggagaa

SEQ ID NO: 46609 - RNA, 18 nt, Homo sapiens
uguauaaaauaauuuuua

SEQ ID NO: 46610 - RNA, 20 nt, Homo sapiens
uguauaaaauaauuuuuaua

SEQ ID NO: 46611 - RNA, 21 nt, Homo sapiens
uguauauuuuauaucaauuua

SEQ ID NO: 46612 - RNA, 16 nt, Homo sapiens
uguaucuuauucacau

SEQ ID NO: 46613 - RNA, 21 nt, Homo sapiens
uguauguaaauagcuaagaua

SEQ ID NO: 46614 - RNA, 9 nt, Homo sapiens
uguauucuu

SEQ ID NO: 46615 - RNA, 14 nt, Homo sapiens
uguauuuuaaaaga

SEQ ID NO: 46616 - RNA, 17 nt, Homo sapiens
uguauuuuauuacaucu

SEQ ID NO: 46617 - RNA, 14 nt, Homo sapiens
ugucaaugcagccc

SEQ ID NO: 46618 - RNA, 16 nt, Homo sapiens
ugucagccacugugau

SEQ ID NO: 46619 - RNA, 20 nt, Homo sapiens
uguccauucuuccucccauu

SEQ ID NO: 46620 - RNA, 17 nt, Homo sapiens
uguccgcuauccaccaa

SEQ ID NO: 46621 - RNA, 16 nt, Homo sapiens
ugucucaguccaugaa

SEQ ID NO: 46622 - RNA, 21 nt, Homo sapiens
ugucucggagggauuccccua

SEQ ID NO: 46623 - RNA, 21 nt, Homo sapiens
ugucuuaauuaaaagaauauu

SEQ ID NO: 46624 - RNA, 18 nt, Homo sapiens
ugucuucauagcagauuu

SEQ ID NO: 46625 - RNA, 23 nt, Homo sapiens
ugugaaacuggauuaaacuuaau

SEQ ID NO: 46626 - RNA, 15 nt, Homo sapiens
ugugaacacaucagc

SEQ ID NO: 46627 - RNA, 19 nt, Homo sapiens
ugugaacacaucagcuugc

SEQ ID NO: 46628 - RNA, 14 nt, Homo sapiens
ugugaacccaaagu

SEQ ID NO: 46629 - RNA, 16 nt, Homo sapiens
ugugaacccaaagugu

SEQ ID NO: 46630 - RNA, 18 nt, Homo sapiens
ugugaacccaaaguguga

SEQ ID NO: 46631 - RNA, 10 nt, Homo sapiens
ugugaagcaa

SEQ ID NO: 46632 - RNA, 11 nt, Homo sapiens
ugugaagcaaa

SEQ ID NO: 46633 - RNA, 18 nt, Homo sapiens
ugugaaguuuaauugacu

SEQ ID NO: 46634 - RNA, 21 nt, Homo sapiens
ugugacuuaaugccacuaaau

SEQ ID NO: 46635 - RNA, 22 nt, Homo sapiens
ugugauauguaccuaacgaagu

SEQ ID NO: 46636 - RNA, 12 nt, Homo sapiens
ugugaugaucua

SEQ ID NO: 46637 - RNA, 15 nt, Homo sapiens
ugugauuacaaggcu

SEQ ID NO: 46638 - RNA, 9 nt, Homo sapiens
ugugcaaua

SEQ ID NO: 46639 - RNA, 23 nt, Homo sapiens
ugugcacaucuguuuuguaacug

SEQ ID NO: 46640 - RNA, 15 nt, Homo sapiens
ugugcauauuuuauu

SEQ ID NO: 46641 - RNA, 16 nt, Homo sapiens
ugugcauuuaauuaga

SEQ ID NO: 46642 - RNA, 14 nt, Homo sapiens
ugugccuucauuuu

SEQ ID NO: 46643 - RNA, 11 nt, Homo sapiens
ugugcggccug

SEQ ID NO: 46644 - RNA, 12 nt, Homo sapiens
ugugcggccugg

SEQ ID NO: 46645 - RNA, 14 nt, Homo sapiens
ugugcggccugguc

SEQ ID NO: 46646 - RNA, 21 nt, Homo sapiens
ugugcggccuggucuaccugu

SEQ ID NO: 46647 - RNA, 18 nt, Homo sapiens
ugugcuaguaauuggaaa

SEQ ID NO: 46648 - RNA, 19 nt, Homo sapiens
ugugcuaguaauuggaaag

SEQ ID NO: 46649 - RNA, 15 nt, Homo sapiens
ugugggaaauccaca

SEQ ID NO: 46650 - RNA, 17 nt, Homo sapiens
uguguaagacaaaaagc

SEQ ID NO: 46651 - RNA, 13 nt, Homo sapiens
uguguaaguagau

SEQ ID NO: 46652 - RNA, 16 nt, Homo sapiens
ugugucaguggaugcu

SEQ ID NO: 46653 - RNA, 21 nt, Homo sapiens
ugugucucaggugugcccuga

SEQ ID NO: 46654 - RNA, 16 nt, Homo sapiens
uguguggcauuuucac

SEQ ID NO: 46655 - RNA, 19 nt, Homo sapiens
uguguggucaacauuucuc

SEQ ID NO: 46656 - RNA, 12 nt, Homo sapiens
uguguuacugau

SEQ ID NO: 46657 - RNA, 22 nt, Homo sapiens
uguguuccuaacaggaauuuuc

SEQ ID NO: 46658 - RNA, 17 nt, Homo sapiens
uguguuuauuucacuug

SEQ ID NO: 46659 - RNA, 13 nt, Homo sapiens
uguguuucuuuag

SEQ ID NO: 46660 - RNA, 14 nt, Homo sapiens
uguguuugaagcac

SEQ ID NO: 46661 - RNA, 16 nt, Homo sapiens
uguguuuugcaagcca

SEQ ID NO: 46662 - RNA, 18 nt, Homo sapiens
uguuaaaacugggacagg

SEQ ID NO: 46663 - RNA, 20 nt, Homo sapiens
uguuaauaaaaguacauguu

SEQ ID NO: 46664 - RNA, 15 nt, Homo sapiens
uguuaaucuuucaaa

SEQ ID NO: 46665 - RNA, 14 nt, Homo sapiens
uguuacauuuuuaa

SEQ ID NO: 46666 - RNA, 17 nt, Homo sapiens
uguuacuaaguuuuuau

SEQ ID NO: 46667 - RNA, 19 nt, Homo sapiens
uguuacuaaguuuuuaugg

SEQ ID NO: 46668 - RNA, 19 nt, Homo sapiens
uguuagagaauuuccuuac

SEQ ID NO: 46669 - RNA, 15 nt, Homo sapiens
uguuaucuucacuuu

SEQ ID NO: 46670 - RNA, 17 nt, Homo sapiens
uguuauuuauugaaaug

SEQ ID NO: 46671 - RNA, 18 nt, Homo sapiens
uguuauuuuaucugcuau

SEQ ID NO: 46672 - RNA, 20 nt, Homo sapiens
uguucacagccagacuggca

SEQ ID NO: 46673 - RNA, 13 nt, Homo sapiens
uguuccucgccac

SEQ ID NO: 46674 - RNA, 14 nt, Homo sapiens
uguuccucgccacg

SEQ ID NO: 46675 - RNA, 12 nt, Homo sapiens
uguucgcgcgcc

SEQ ID NO: 46676 - RNA, 17 nt, Homo sapiens
uguucgcgcgccuccgc

SEQ ID NO: 46677 - RNA, 19 nt, Homo sapiens
uguucgcgcgccuccgcua

SEQ ID NO: 46678 - RNA, 16 nt, Homo sapiens
uguucuugguuuguaa

SEQ ID NO: 46679 - RNA, 12 nt, Homo sapiens
uguucuugugaa

SEQ ID NO: 46680 - RNA, 17 nt, Homo sapiens
uguugacaugggacauu

SEQ ID NO: 46681 - RNA, 14 nt, Homo sapiens
uguugccaaggcug

SEQ ID NO: 46682 - RNA, 24 nt, Homo sapiens
uguugccaaggcuggagugcagug

SEQ ID NO: 46683 - RNA, 16 nt, Homo sapiens
uguugcuaucaaucca

SEQ ID NO: 46684 - RNA, 20 nt, Homo sapiens
uguugcuaucaauccaagaa

SEQ ID NO: 46685 - RNA, 18 nt, Homo sapiens
uguugguacuagauacug

SEQ ID NO: 46686 - RNA, 21 nt, Homo sapiens
uguuuaaaaucauuucugcau

SEQ ID NO: 46687 - RNA, 22 nt, Homo sapiens
uguuuacaaaccucaagccagc

SEQ ID NO: 46688 - RNA, 13 nt, Homo sapiens
uguuuauuuguuu

SEQ ID NO: 46689 - RNA, 17 nt, Homo sapiens
uguuuccauagggugac

SEQ ID NO: 46690 - RNA, 19 nt, Homo sapiens
uguuuccuagcacacacuu

SEQ ID NO: 46691 - RNA, 22 nt, Homo sapiens
uguuuccuagcacacacuuuug

SEQ ID NO: 46692 - RNA, 15 nt, Homo sapiens
uguuuuaaggaugcu

SEQ ID NO: 46693 - RNA, 22 nt, Homo sapiens
uguuuuauuuaaccucuaaauu

SEQ ID NO: 46694 - RNA, 22 nt, Homo sapiens
uguuuucauagagaauauaaaa

SEQ ID NO: 46695 - RNA, 21 nt, Homo sapiens
uguuuucugacuaauuaggca

SEQ ID NO: 46696 - RNA, 15 nt, Homo sapiens
uguuuuuaaacugga

SEQ ID NO: 46697 - RNA, 13 nt, Homo sapiens
uguuuuuaagcug

SEQ ID NO: 46698 - RNA, 18 nt, Homo sapiens
uuaaaaaaaaaccugagc

SEQ ID NO: 46699 - RNA, 21 nt, Homo sapiens
uuaaaaaaaaaccugagcccc

SEQ ID NO: 46700 - RNA, 20 nt, Homo sapiens
uuaaaaaaaaauacugaugu

SEQ ID NO: 46701 - RNA, 11 nt, Homo sapiens
uuaaaaucaca

SEQ ID NO: 46702 - RNA, 19 nt, Homo sapiens
uuaaaauuaucaauaucua

SEQ ID NO: 46703 - RNA, 21 nt, Homo sapiens
uuaaacucagggagcauuuau

SEQ ID NO: 46704 - RNA, 20 nt, Homo sapiens
uuaaagcuuauuaaaacuca

SEQ ID NO: 46705 - RNA, 23 nt, Homo sapiens
uuaaauagcuuuuuucucugaua

SEQ ID NO: 46706 - RNA, 18 nt, Homo sapiens
uuaaauggaaguaaaugu

SEQ ID NO: 46707 - RNA, 18 nt, Homo sapiens
uuaaauggagaaaggacc

SEQ ID NO: 46708 - RNA, 19 nt, Homo sapiens
uuaaauggagaaaggaccc

SEQ ID NO: 46709 - RNA, 14 nt, Homo sapiens
uuaacacagugucu

SEQ ID NO: 46710 - RNA, 22 nt, Homo sapiens
uuaacugagaaggcuguggauu

SEQ ID NO: 46711 - RNA, 22 nt, Homo sapiens
uuaagaaucuuuauaguucuac

SEQ ID NO: 46712 - RNA, 18 nt, Homo sapiens
uuaagagagucuauuuac

SEQ ID NO: 46713 - RNA, 16 nt, Homo sapiens
uuaagcuuucagcuca

SEQ ID NO: 46714 - RNA, 19 nt, Homo sapiens
uuaaggauuuuaugcuuua

SEQ ID NO: 46715 - RNA, 20 nt, Homo sapiens
uuaaggauuuuaugcuuuaa

SEQ ID NO: 46716 - RNA, 23 nt, Homo sapiens
uuaaguguaacuggcaguuuucc

SEQ ID NO: 46717 - RNA, 22 nt, Homo sapiens
uuaaguuacacauuuuucagau

SEQ ID NO: 46718 - RNA, 20 nt, Homo sapiens
uuaaguuuuuuuuuaaaaaa

SEQ ID NO: 46719 - RNA, 14 nt, Homo sapiens
uuaauaaaaguaca

SEQ ID NO: 46720 - RNA, 22 nt, Homo sapiens
uuaauaaaccauuuuuacuugg

SEQ ID NO: 46721 - RNA, 11 nt, Homo sapiens
uuaauaucauc

SEQ ID NO: 46722 - RNA, 13 nt, Homo sapiens
uuaauccucucaa

SEQ ID NO: 46723 - RNA, 20 nt, Homo sapiens
uuaauuacuucuuaguaugu

SEQ ID NO: 46724 - RNA, 17 nt, Homo sapiens
uuaauuauuucacuuua

SEQ ID NO: 46725 - RNA, 20 nt, Homo sapiens
uuaauuuauugaggcuuuaa

SEQ ID NO: 46726 - RNA, 20 nt, Homo sapiens
uuaauuugguuuucacauug

SEQ ID NO: 46727 - RNA, 20 nt, Homo sapiens
uuacaaugcauucugaggua

SEQ ID NO: 46728 - RNA, 18 nt, Homo sapiens
uuacagagaaaagacaua

SEQ ID NO: 46729 - RNA, 20 nt, Homo sapiens
uuacaggcgugagccaccaa

SEQ ID NO: 46730 - RNA, 13 nt, Homo sapiens
uuacaucuuucac

SEQ ID NO: 46731 - RNA, 18 nt, Homo sapiens
uuaccacuuguguuuugc

SEQ ID NO: 46732 - RNA, 18 nt, Homo sapiens
uuacccucauguucuuaa

SEQ ID NO: 46733 - RNA, 12 nt, Homo sapiens
uuaccucugaua

SEQ ID NO: 46734 - RNA, 15 nt, Homo sapiens
uuaccugggaaaggg

SEQ ID NO: 46735 - RNA, 20 nt, Homo sapiens
uuacguccuuccacuuccaa

SEQ ID NO: 46736 - RNA, 21 nt, Homo sapiens
uuacuaaacauguauguaaau

SEQ ID NO: 46737 - RNA, 23 nt, Homo sapiens
uuacuauuuauugcugaaugacu

SEQ ID NO: 46738 - RNA, 11 nt, Homo sapiens
uuacucugaag

SEQ ID NO: 46739 - RNA, 13 nt, Homo sapiens
uuacuguacauga

SEQ ID NO: 46740 - RNA, 15 nt, Homo sapiens
uuacuuaguguuaug

SEQ ID NO: 46741 - RNA, 18 nt, Homo sapiens
uuacuucuucucauacua

SEQ ID NO: 46742 - RNA, 20 nt, Homo sapiens
uuagacccucaugcugccaa

SEQ ID NO: 46743 - RNA, 21 nt, Homo sapiens
uuagacccucaugcugccaau

SEQ ID NO: 46744 - RNA, 19 nt, Homo sapiens
uuagcaaaucuacugucaa

SEQ ID NO: 46745 - RNA, 16 nt, Homo sapiens
uuagcagauuuaagau

SEQ ID NO: 46746 - RNA, 10 nt, Homo sapiens
uuagccgggc

SEQ ID NO: 46747 - RNA, 11 nt, Homo sapiens
uuagccgggca

SEQ ID NO: 46748 - RNA, 12 nt, Homo sapiens
uuagccgggcau

SEQ ID NO: 46749 - RNA, 11 nt, Homo sapiens
uuagccgggcg

SEQ ID NO: 46750 - RNA, 13 nt, Homo sapiens
uuagccgggcgug

SEQ ID NO: 46751 - RNA, 18 nt, Homo sapiens
uuagccgggcgugguggu

SEQ ID NO: 46752 - RNA, 12 nt, Homo sapiens
uuagcuggaaaa

SEQ ID NO: 46753 - RNA, 24 nt, Homo sapiens
uuagcuggaaaaguauguuagugc

SEQ ID NO: 46754 - RNA, 21 nt, Homo sapiens
uuaggaguaccauaauucugg

SEQ ID NO: 46755 - RNA, 15 nt, Homo sapiens
uuaggcuauucacaa

SEQ ID NO: 46756 - RNA, 21 nt, Homo sapiens
uuagugcuuugagauugugaa

SEQ ID NO: 46757 - RNA, 14 nt, Homo sapiens
uuaguguacaugaa

SEQ ID NO: 46758 - RNA, 15 nt, Homo sapiens
uuauaaaucgcuuuu

SEQ ID NO: 46759 - RNA, 18 nt, Homo sapiens
uuauaaaucgcuuuugau

SEQ ID NO: 46760 - RNA, 18 nt, Homo sapiens
uuauaauguagcagcuca

SEQ ID NO: 46761 - RNA, 18 nt, Homo sapiens
uuauaauuccuauauccu

SEQ ID NO: 46762 - RNA, 21 nt, Homo sapiens
uuauagaauauuuauuaccuc

SEQ ID NO: 46763 - RNA, 13 nt, Homo sapiens
uuauaugcuauuu

SEQ ID NO: 46764 - RNA, 14 nt, Homo sapiens
uuauauucauucuu

SEQ ID NO: 46765 - RNA, 14 nt, Homo sapiens
uuauauuugaaaua

SEQ ID NO: 46766 - RNA, 16 nt, Homo sapiens
uuauauuugaaauauu

SEQ ID NO: 46767 - RNA, 12 nt, Homo sapiens
uuaucaguccaa

SEQ ID NO: 46768 - RNA, 21 nt, Homo sapiens
uuaucaugcaaaugcuguauu

SEQ ID NO: 46769 - RNA, 10 nt, Homo sapiens
uuaucauuua

SEQ ID NO: 46770 - RNA, 20 nt, Homo sapiens
uuaucugcuaugcuauugaa

SEQ ID NO: 46771 - RNA, 15 nt, Homo sapiens
uuaucuugucucugg

SEQ ID NO: 46772 - RNA, 18 nt, Homo sapiens
uuaugaaacauuacaguu

SEQ ID NO: 46773 - RNA, 16 nt, Homo sapiens
uuaugaaccuuuacau

SEQ ID NO: 46774 - RNA, 20 nt, Homo sapiens
uuaugaaccuuuacauccag

SEQ ID NO: 46775 - RNA, 15 nt, Homo sapiens
uuaugauuaaguaau

SEQ ID NO: 46776 - RNA, 16 nt, Homo sapiens
uuaugcuaagugaaau

SEQ ID NO: 46777 - RNA, 18 nt, Homo sapiens
uuauggcuuuugugcauu

SEQ ID NO: 46778 - RNA, 11 nt, Homo sapiens
uuaugugcaau

SEQ ID NO: 46779 - RNA, 12 nt, Homo sapiens
uuaugugcaaua

SEQ ID NO: 46780 - RNA, 16 nt, Homo sapiens
uuauuacaucuuucac

SEQ ID NO: 46781 - RNA, 12 nt, Homo sapiens
uuauuaccucug

SEQ ID NO: 46782 - RNA, 21 nt, Homo sapiens
uuauuaccucugauaccucaa

SEQ ID NO: 46783 - RNA, 17 nt, Homo sapiens
uuauuauggcacaucag

SEQ ID NO: 46784 - RNA, 13 nt, Homo sapiens
uuauucagaauuu

SEQ ID NO: 46785 - RNA, 14 nt, Homo sapiens
uuauuggacuucca

SEQ ID NO: 46786 - RNA, 14 nt, Homo sapiens
uuauuguaccucuc

SEQ ID NO: 46787 - RNA, 13 nt, Homo sapiens
uuauuguagcauc

SEQ ID NO: 46788 - RNA, 13 nt, Homo sapiens
uuauuucacuuua

SEQ ID NO: 46789 - RNA, 18 nt, Homo sapiens
uuauuuuagagcaucuca

SEQ ID NO: 46790 - RNA, 16 nt, Homo sapiens
uucaaaauuggacuua

SEQ ID NO: 46791 - RNA, 18 nt, Homo sapiens
uucaaacuaauagaauua

SEQ ID NO: 46792 - RNA, 20 nt, Homo sapiens
uucaaaguuaagaaucuuua

SEQ ID NO: 46793 - RNA, 20 nt, Homo sapiens
uucaaauccuugaagauuua

SEQ ID NO: 46794 - RNA, 14 nt, Homo sapiens
uucaaauguauuac

SEQ ID NO: 46795 - RNA, 15 nt, Homo sapiens
uucaaauguucucca

SEQ ID NO: 46796 - RNA, 15 nt, Homo sapiens
uucaagggaccucuc

SEQ ID NO: 46797 - RNA, 17 nt, Homo sapiens
uucaagggaccucucca

SEQ ID NO: 46798 - RNA, 22 nt, Homo sapiens
uucaauaaaacuuuuccaauga

SEQ ID NO: 46799 - RNA, 14 nt, Homo sapiens
uucaauacagauca

SEQ ID NO: 46800 - RNA, 15 nt, Homo sapiens
uucaauccugauuca

SEQ ID NO: 46801 - RNA, 16 nt, Homo sapiens
uucaaucuggauucau

SEQ ID NO: 46802 - RNA, 17 nt, Homo sapiens
uucaaugccccugaauu

SEQ ID NO: 46803 - RNA, 16 nt, Homo sapiens
uucacagauaccucuc

SEQ ID NO: 46804 - RNA, 16 nt, Homo sapiens
uucacagcacuuacaa

SEQ ID NO: 46805 - RNA, 19 nt, Homo sapiens
uucacagccagacuggcac

SEQ ID NO: 46806 - RNA, 20 nt, Homo sapiens
uucaccuuccagugucucgg

SEQ ID NO: 46807 - RNA, 16 nt, Homo sapiens
uucacuuauugacuau

SEQ ID NO: 46808 - RNA, 18 nt, Homo sapiens
uucacuugaugauacaau

SEQ ID NO: 46809 - RNA, 19 nt, Homo sapiens
uucacuuuuauaagaaaua

SEQ ID NO: 46810 - RNA, 17 nt, Homo sapiens
uucagauaacuguuauu

SEQ ID NO: 46811 - RNA, 23 nt, Homo sapiens
uucagauauaaaagacugaccaa

SEQ ID NO: 46812 - RNA, 18 nt, Homo sapiens
uucagcagagaaguuuuc

SEQ ID NO: 46813 - RNA, 16 nt, Homo sapiens
uucagccugaaagagg

SEQ ID NO: 46814 - RNA, 20 nt, Homo sapiens
uucagcucagcuaaugaagu

SEQ ID NO: 46815 - RNA, 15 nt, Homo sapiens
uucaguuuucaggag

SEQ ID NO: 46816 - RNA, 17 nt, Homo sapiens
uucauaccuacauguau

SEQ ID NO: 46817 - RNA, 18 nt, Homo sapiens
uucaucauaauaaauauc

SEQ ID NO: 46818 - RNA, 21 nt, Homo sapiens
uucaugaaaagauuaugaucu

SEQ ID NO: 46819 - RNA, 17 nt, Homo sapiens
uucaugaaggggcggcg

SEQ ID NO: 46820 - RNA, 22 nt, Homo sapiens
uucaugaaggggcggcggcccu

SEQ ID NO: 46821 - RNA, 18 nt, Homo sapiens
uucaugcuguucaugaaa

SEQ ID NO: 46822 - RNA, 21 nt, Homo sapiens
uucauuaucucaaaacugcac

SEQ ID NO: 46823 - RNA, 19 nt, Homo sapiens
uucauucuuuuugaaaugu

SEQ ID NO: 46824 - RNA, 13 nt, Homo sapiens
uucauuguucuau

SEQ ID NO: 46825 - RNA, 17 nt, Homo sapiens
uuccaagaaauauuccu

SEQ ID NO: 46826 - RNA, 14 nt, Homo sapiens
uuccaaugacauuu

SEQ ID NO: 46827 - RNA, 14 nt, Homo sapiens
uuccacuacugcua

SEQ ID NO: 46828 - RNA, 19 nt, Homo sapiens
uuccagagaccaguauucc

SEQ ID NO: 46829 - RNA, 14 nt, Homo sapiens
uuccagauccugga

SEQ ID NO: 46830 - RNA, 17 nt, Homo sapiens
uuccagggcuacgcgcg

SEQ ID NO: 46831 - RNA, 20 nt, Homo sapiens
uuccagggcuacgcgcgcuc

SEQ ID NO: 46832 - RNA, 18 nt, Homo sapiens
uuccaguaguuagcuuuc

SEQ ID NO: 46833 - RNA, 17 nt, Homo sapiens
uuccaucaaggguacac

SEQ ID NO: 46834 - RNA, 14 nt, Homo sapiens
uucccaaaacugau

SEQ ID NO: 46835 - RNA, 18 nt, Homo sapiens
uucccaaauuucauaccu

SEQ ID NO: 46836 - RNA, 13 nt, Homo sapiens
uucccacacuguc

SEQ ID NO: 46837 - RNA, 15 nt, Homo sapiens
uucccacacugucca

SEQ ID NO: 46838 - RNA, 20 nt, Homo sapiens
uucccagcuagaauucacuc

SEQ ID NO: 46839 - RNA, 22 nt, Homo sapiens
uucccagucuucagcagagaag

SEQ ID NO: 46840 - RNA, 17 nt, Homo sapiens
uucccauucuacauacu

SEQ ID NO: 46841 - RNA, 18 nt, Homo sapiens
uucccgcuguuccucgcc

SEQ ID NO: 46842 - RNA, 15 nt, Homo sapiens
uucccugccuggauc

SEQ ID NO: 46843 - RNA, 18 nt, Homo sapiens
uucccuugaugaagaagu

SEQ ID NO: 46844 - RNA, 12 nt, Homo sapiens
uuccgcauccua

SEQ ID NO: 46845 - RNA, 16 nt, Homo sapiens
uuccgcauccuagucu

SEQ ID NO: 46846 - RNA, 13 nt, Homo sapiens
uuccuagcgcagc

SEQ ID NO: 46847 - RNA, 21 nt, Homo sapiens
uuccuauaauuuuagacauuc

SEQ ID NO: 46848 - RNA, 17 nt, Homo sapiens
uuccucaaaacuucaga

SEQ ID NO: 46849 - RNA, 15 nt, Homo sapiens
uuccucacuuugaag

SEQ ID NO: 46850 - RNA, 18 nt, Homo sapiens
uuccucacuuugaagagu

SEQ ID NO: 46851 - RNA, 12 nt, Homo sapiens
uuccucccggcc

SEQ ID NO: 46852 - RNA, 14 nt, Homo sapiens
uuccucccggccgc

SEQ ID NO: 46853 - RNA, 16 nt, Homo sapiens
uuccucccggccgcgc

SEQ ID NO: 46854 - RNA, 13 nt, Homo sapiens
uuccucgccacgc

SEQ ID NO: 46855 - RNA, 14 nt, Homo sapiens
uuccugagaccagc

SEQ ID NO: 46856 - RNA, 15 nt, Homo sapiens
uuccugagaccagcc

SEQ ID NO: 46857 - RNA, 21 nt, Homo sapiens
uuccugagaccagccaaccug

SEQ ID NO: 46858 - RNA, 11 nt, Homo sapiens
uuccugcaaug

SEQ ID NO: 46859 - RNA, 21 nt, Homo sapiens
uuccugcaaugaagucucuga

SEQ ID NO: 46860 - RNA, 16 nt, Homo sapiens
uuccugggagcuuuug

SEQ ID NO: 46861 - RNA, 19 nt, Homo sapiens
uuccuuauucagaauuucu

SEQ ID NO: 46862 - RNA, 13 nt, Homo sapiens
uucgcgcgccucc

SEQ ID NO: 46863 - RNA, 15 nt, Homo sapiens
uucgcgcgccuccgc

SEQ ID NO: 46864 - RNA, 16 nt, Homo sapiens
uucuaaaggcuaccuu

SEQ ID NO: 46865 - RNA, 15 nt, Homo sapiens
uucuaggacugaauu

SEQ ID NO: 46866 - RNA, 14 nt, Homo sapiens
uucuagggaaauga

SEQ ID NO: 46867 - RNA, 13 nt, Homo sapiens
uucuaugaaauau

SEQ ID NO: 46868 - RNA, 17 nt, Homo sapiens
uucuauggcauauugau

SEQ ID NO: 46869 - RNA, 14 nt, Homo sapiens
uucuauguuaauau

SEQ ID NO: 46870 - RNA, 17 nt, Homo sapiens
uucuauuacgugcaaua

SEQ ID NO: 46871 - RNA, 22 nt, Homo sapiens
uucuauuacgugcaauacuuca

SEQ ID NO: 46872 - RNA, 15 nt, Homo sapiens
uucuauuuauuuacu

SEQ ID NO: 46873 - RNA, 16 nt, Homo sapiens
uucucaccugugagac

SEQ ID NO: 46874 - RNA, 16 nt, Homo sapiens
uucucuaacucagaaa

SEQ ID NO: 46875 - RNA, 22 nt, Homo sapiens
uucucuagucauuuguuaauau

SEQ ID NO: 46876 - RNA, 22 nt, Homo sapiens
uucucuucacagucacauucca

SEQ ID NO: 46877 - RNA, 16 nt, Homo sapiens
uucugagguaaccuca

SEQ ID NO: 46878 - RNA, 22 nt, Homo sapiens
uucugcagauaaacaguaguga

SEQ ID NO: 46879 - RNA, 19 nt, Homo sapiens
uucugucacggucacuuua

SEQ ID NO: 46880 - RNA, 20 nt, Homo sapiens
uucugucuggacuuuccaga

SEQ ID NO: 46881 - RNA, 22 nt, Homo sapiens
uucugugggagaauucuuacau

SEQ ID NO: 46882 - RNA, 15 nt, Homo sapiens
uucuguuuuauaauu

SEQ ID NO: 46883 - RNA, 21 nt, Homo sapiens
uucuuaaauaauaaagaucau

SEQ ID NO: 46884 - RNA, 19 nt, Homo sapiens
uucuuaagacgugauuuug

SEQ ID NO: 46885 - RNA, 21 nt, Homo sapiens
uucuucuuggucucaguguca

SEQ ID NO: 46886 - RNA, 15 nt, Homo sapiens
uucuugcaaaguauc

SEQ ID NO: 46887 - RNA, 15 nt, Homo sapiens
uucuuguaaggcaua

SEQ ID NO: 46888 - RNA, 16 nt, Homo sapiens
uucuuguacucuacaa

SEQ ID NO: 46889 - RNA, 18 nt, Homo sapiens
uucuuuuugaaaugucaa

SEQ ID NO: 46890 - RNA, 13 nt, Homo sapiens
uugaaaaaguaua

SEQ ID NO: 46891 - RNA, 17 nt, Homo sapiens
uugaaaagacuccaaag

SEQ ID NO: 46892 - RNA, 15 nt, Homo sapiens
uugaaacugagaugu

SEQ ID NO: 46893 - RNA, 15 nt, Homo sapiens
uugaaauagugucug

SEQ ID NO: 46894 - RNA, 17 nt, Homo sapiens
uugaaaugauuucacag

SEQ ID NO: 46895 - RNA, 12 nt, Homo sapiens
uugaaaugucaa

SEQ ID NO: 46896 - RNA, 14 nt, Homo sapiens
uugaagagguuuua

SEQ ID NO: 46897 - RNA, 21 nt, Homo sapiens
uugaagaugcuuguauuuuac

SEQ ID NO: 46898 - RNA, 14 nt, Homo sapiens
uugaaugugucagg

SEQ ID NO: 46899 - RNA, 20 nt, Homo sapiens
uugacccacaagaaaugaaa

SEQ ID NO: 46900 - RNA, 20 nt, Homo sapiens
uugacuauuauagaauggaa

SEQ ID NO: 46901 - RNA, 20 nt, Homo sapiens
uugagaaauuaaguaucuga

SEQ ID NO: 46902 - RNA, 12 nt, Homo sapiens
uugagcaccugc

SEQ ID NO: 46903 - RNA, 17 nt, Homo sapiens
uugagcuagggggguca

SEQ ID NO: 46904 - RNA, 23 nt, Homo sapiens
uugagcuaggggggucagccagc

SEQ ID NO: 46905 - RNA, 21 nt, Homo sapiens
uugaugaagaaguugauaugc

SEQ ID NO: 46906 - RNA, 19 nt, Homo sapiens
uugaugauuaauucaccuu

SEQ ID NO: 46907 - RNA, 18 nt, Homo sapiens
uugauggugguauguuuu

SEQ ID NO: 46908 - RNA, 15 nt, Homo sapiens
uugauguuuucacaa

SEQ ID NO: 46909 - RNA, 12 nt, Homo sapiens
uugcaaccccau

SEQ ID NO: 46910 - RNA, 15 nt, Homo sapiens
uugcaagacauagaa

SEQ ID NO: 46911 - RNA, 23 nt, Homo sapiens
uugcauuuaauuuauugaggcuu

SEQ ID NO: 46912 - RNA, 21 nt, Homo sapiens
uugccaaggcuggagugcagu

SEQ ID NO: 46913 - RNA, 21 nt, Homo sapiens
uugccaugagaguucugucac

SEQ ID NO: 46914 - RNA, 20 nt, Homo sapiens
uugccaugcuggccaggcug

SEQ ID NO: 46915 - RNA, 15 nt, Homo sapiens
uugccucuugcaauu

SEQ ID NO: 46916 - RNA, 17 nt, Homo sapiens
uugcuaucaauccaaga

SEQ ID NO: 46917 - RNA, 13 nt, Homo sapiens
uugcugcaccugu

SEQ ID NO: 46918 - RNA, 17 nt, Homo sapiens
uugcugcaccugugccg

SEQ ID NO: 46919 - RNA, 15 nt, Homo sapiens
uugcuggagcucugc

SEQ ID NO: 46920 - RNA, 17 nt, Homo sapiens
uugcuggagcucugccc

SEQ ID NO: 46921 - RNA, 11 nt, Homo sapiens
uugcuguagaa

SEQ ID NO: 46922 - RNA, 15 nt, Homo sapiens
uugcuugaacccagg

SEQ ID NO: 46923 - RNA, 17 nt, Homo sapiens
uugcuuuucaacacaca

SEQ ID NO: 46924 - RNA, 15 nt, Homo sapiens
uuggaagguauuuaa

SEQ ID NO: 46925 - RNA, 12 nt, Homo sapiens
uuggagaagaac

SEQ ID NO: 46926 - RNA, 18 nt, Homo sapiens
uuggcccaggaguuuggc

SEQ ID NO: 46927 - RNA, 22 nt, Homo sapiens
uuggcccaggaguuuggccaga

SEQ ID NO: 46928 - RNA, 14 nt, Homo sapiens
uugggaggcugagg

SEQ ID NO: 46929 - RNA, 15 nt, Homo sapiens
uugggaggcugaggc

SEQ ID NO: 46930 - RNA, 22 nt, Homo sapiens
uugggaggcugaggcaagagaa

SEQ ID NO: 46931 - RNA, 22 nt, Homo sapiens
uugggggggaggugagguacca

SEQ ID NO: 46932 - RNA, 21 nt, Homo sapiens
uugguacuagauacugaaugu

SEQ ID NO: 46933 - RNA, 17 nt, Homo sapiens
uuggugccucaguuucc

SEQ ID NO: 46934 - RNA, 20 nt, Homo sapiens
uugguucuaauagaacucag

SEQ ID NO: 46935 - RNA, 18 nt, Homo sapiens
uuguacaccaauauucau

SEQ ID NO: 46936 - RNA, 17 nt, Homo sapiens
uuguaccgcaaugugac

SEQ ID NO: 46937 - RNA, 16 nt, Homo sapiens
uuguagcguacaucaa

SEQ ID NO: 46938 - RNA, 19 nt, Homo sapiens
uuguauucucuccuguacc

SEQ ID NO: 46939 - RNA, 12 nt, Homo sapiens
uugugcauuugg

SEQ ID NO: 46940 - RNA, 21 nt, Homo sapiens
uuguguaaugaaaaugaauau

SEQ ID NO: 46941 - RNA, 16 nt, Homo sapiens
uuguguuugaagcaca

SEQ ID NO: 46942 - RNA, 13 nt, Homo sapiens
uuguucuugugaa

SEQ ID NO: 46943 - RNA, 16 nt, Homo sapiens
uuguuuaaaaucauuu

SEQ ID NO: 46944 - RNA, 22 nt, Homo sapiens
uuguuugagaaauuaaguaucu

SEQ ID NO: 46945 - RNA, 19 nt, Homo sapiens
uuguuugcauaggugaucu

SEQ ID NO: 46946 - RNA, 21 nt, Homo sapiens
uuguuuuaaaauuaaagcuaa

SEQ ID NO: 46947 - RNA, 14 nt, Homo sapiens
uuguuuucauuauc

SEQ ID NO: 46948 - RNA, 16 nt, Homo sapiens
uuguuuuuaaacugga

SEQ ID NO: 46949 - RNA, 23 nt, Homo sapiens
uuuaaaaaaaaaaaaaaagccaa

SEQ ID NO: 46950 - RNA, 17 nt, Homo sapiens
uuuaaaaaaaaaacgua

SEQ ID NO: 46951 - RNA, 21 nt, Homo sapiens
uuuaaaaaaaaaccugagccc

SEQ ID NO: 46952 - RNA, 18 nt, Homo sapiens
uuuaaaauacacacucaa

SEQ ID NO: 46953 - RNA, 21 nt, Homo sapiens
uuuaaagcuuauuaaaacuca

SEQ ID NO: 46954 - RNA, 13 nt, Homo sapiens
uuuaaagggaugg

SEQ ID NO: 46955 - RNA, 16 nt, Homo sapiens
uuuaaaugcaccugga

SEQ ID NO: 46956 - RNA, 19 nt, Homo sapiens
uuuaaauuaaauaaaauuu

SEQ ID NO: 46957 - RNA, 20 nt, Homo sapiens
uuuaaauuaaauaaaauuuu

SEQ ID NO: 46958 - RNA, 21 nt, Homo sapiens
uuuaacuagaauuuauucaau

SEQ ID NO: 46959 - RNA, 14 nt, Homo sapiens
uuuaaguaauuuca

SEQ ID NO: 46960 - RNA, 18 nt, Homo sapiens
uuuaauagguuuggacaa

SEQ ID NO: 46961 - RNA, 19 nt, Homo sapiens
uuuaauagguuuggacaaa

SEQ ID NO: 46962 - RNA, 16 nt, Homo sapiens
uuuaaucaccaaggcu

SEQ ID NO: 46963 - RNA, 17 nt, Homo sapiens
uuuaauggcaugucaga

SEQ ID NO: 46964 - RNA, 17 nt, Homo sapiens
uuuaauuugguuuucac

SEQ ID NO: 46965 - RNA, 12 nt, Homo sapiens
uuuacaacuggg

SEQ ID NO: 46966 - RNA, 11 nt, Homo sapiens
uuuacaguguu

SEQ ID NO: 46967 - RNA, 21 nt, Homo sapiens
uuuacauacugcugucuaugu

SEQ ID NO: 46968 - RNA, 11 nt, Homo sapiens
uuuacuuuguu

SEQ ID NO: 46969 - RNA, 18 nt, Homo sapiens
uuuagaagauucuauguu

SEQ ID NO: 46970 - RNA, 15 nt, Homo sapiens
uuuagaugaauguca

SEQ ID NO: 46971 - RNA, 13 nt, Homo sapiens
uuuagcuggaaaa

SEQ ID NO: 46972 - RNA, 15 nt, Homo sapiens
uuuagggaccugcug

SEQ ID NO: 46973 - RNA, 16 nt, Homo sapiens
uuuauaaauggacaaa

SEQ ID NO: 46974 - RNA, 13 nt, Homo sapiens
uuuauaugcuauu

SEQ ID NO: 46975 - RNA, 17 nt, Homo sapiens
uuuaucuugucucuggg

SEQ ID NO: 46976 - RNA, 14 nt, Homo sapiens
uuuaugauuccacc

SEQ ID NO: 46977 - RNA, 15 nt, Homo sapiens
uuuaugcuaagugaa

SEQ ID NO: 46978 - RNA, 13 nt, Homo sapiens
uuuauguaauuau

SEQ ID NO: 46979 - RNA, 11 nt, Homo sapiens
uuuaugugcaa

SEQ ID NO: 46980 - RNA, 13 nt, Homo sapiens
uuuaugugcaaua

SEQ ID NO: 46981 - RNA, 13 nt, Homo sapiens
uuuauuaccucug

SEQ ID NO: 46982 - RNA, 13 nt, Homo sapiens
uuuauuauauaua

SEQ ID NO: 46983 - RNA, 13 nt, Homo sapiens
uuuauugccauga

SEQ ID NO: 46984 - RNA, 24 nt, Homo sapiens
uuucaaaaucaaauuccagaauga

SEQ ID NO: 46985 - RNA, 12 nt, Homo sapiens
uuucaaacuuua

SEQ ID NO: 46986 - RNA, 21 nt, Homo sapiens
uuucaccuguuuuuaagcugu

SEQ ID NO: 46987 - RNA, 20 nt, Homo sapiens
uuucacuuuuggcuuguaaa

SEQ ID NO: 46988 - RNA, 17 nt, Homo sapiens
uuucagugcacuaaugu

SEQ ID NO: 46989 - RNA, 20 nt, Homo sapiens
uuucauaagaauucuguuga

SEQ ID NO: 46990 - RNA, 19 nt, Homo sapiens
uuucauaccuaucaucuua

SEQ ID NO: 46991 - RNA, 22 nt, Homo sapiens
uuucaugaaaagauuaugaucu

SEQ ID NO: 46992 - RNA, 16 nt, Homo sapiens
uuucaugaaggggcgg

SEQ ID NO: 46993 - RNA, 19 nt, Homo sapiens
uuucaugaaggggcggcgg

SEQ ID NO: 46994 - RNA, 18 nt, Homo sapiens
uuucaugcuguucaugaa

SEQ ID NO: 46995 - RNA, 23 nt, Homo sapiens
uuucauuuuagggguagcauuug

SEQ ID NO: 46996 - RNA, 15 nt, Homo sapiens
uuuccaaauucacaa

SEQ ID NO: 46997 - RNA, 18 nt, Homo sapiens
uuuccacuacugcuacca

SEQ ID NO: 46998 - RNA, 21 nt, Homo sapiens
uuuccagguuccugagcccua

SEQ ID NO: 46999 - RNA, 14 nt, Homo sapiens
uuucccaacuccag

SEQ ID NO: 47000 - RNA, 19 nt, Homo sapiens
uuucccuucuuacaaugca

SEQ ID NO: 47001 - RNA, 16 nt, Homo sapiens
uuucuaggacugaauu

SEQ ID NO: 47002 - RNA, 10 nt, Homo sapiens
uuucugaaau

SEQ ID NO: 47003 - RNA, 14 nt, Homo sapiens
uuucugagaaagac

SEQ ID NO: 47004 - RNA, 18 nt, Homo sapiens
uuucuggaggucucugaa

SEQ ID NO: 47005 - RNA, 21 nt, Homo sapiens
uuucuuccuuuuuuaguucuu

SEQ ID NO: 47006 - RNA, 17 nt, Homo sapiens
uuugaaaccaaaccaga

SEQ ID NO: 47007 - RNA, 22 nt, Homo sapiens
uuugaacaacucgaaucacuca

SEQ ID NO: 47008 - RNA, 22 nt, Homo sapiens
uuugaacuagaguuuagcugga

SEQ ID NO: 47009 - RNA, 16 nt, Homo sapiens
uuugaagagugugagg

SEQ ID NO: 47010 - RNA, 16 nt, Homo sapiens
uuugaagauagaaggu

SEQ ID NO: 47011 - RNA, 18 nt, Homo sapiens
uuugaagguagaauguuu

SEQ ID NO: 47012 - RNA, 15 nt, Homo sapiens
uuugaauuuuaaauc

SEQ ID NO: 47013 - RNA, 18 nt, Homo sapiens
uuugagaaauuaaguauc

SEQ ID NO: 47014 - RNA, 14 nt, Homo sapiens
uuugagcucuggaa

SEQ ID NO: 47015 - RNA, 13 nt, Homo sapiens
uuugauguuuuaa

SEQ ID NO: 47016 - RNA, 13 nt, Homo sapiens
uuugcaagacaua

SEQ ID NO: 47017 - RNA, 20 nt, Homo sapiens
uuugcagauauucucuaguc

SEQ ID NO: 47018 - RNA, 17 nt, Homo sapiens
uuugcagcugugccaua

SEQ ID NO: 47019 - RNA, 21 nt, Homo sapiens
uuugccaugcuggccaggcug

SEQ ID NO: 47020 - RNA, 16 nt, Homo sapiens
uuugcuaagcauucca

SEQ ID NO: 47021 - RNA, 19 nt, Homo sapiens
uuugcuaagcauuccaacu

SEQ ID NO: 47022 - RNA, 23 nt, Homo sapiens
uuugcuaagcauuccaacuaucu

SEQ ID NO: 47023 - RNA, 19 nt, Homo sapiens
uuugcucauggaauuggag

SEQ ID NO: 47024 - RNA, 11 nt, Homo sapiens
uuugcuguaga

SEQ ID NO: 47025 - RNA, 12 nt, Homo sapiens
uuugcuguagaa

SEQ ID NO: 47026 - RNA, 17 nt, Homo sapiens
uuugguucuaggccggg

SEQ ID NO: 47027 - RNA, 13 nt, Homo sapiens
uuugguugcuuua

SEQ ID NO: 47028 - RNA, 18 nt, Homo sapiens
uuugguugcuuuaauauc

SEQ ID NO: 47029 - RNA, 22 nt, Homo sapiens
uuuguagaagucacauuccuga

SEQ ID NO: 47030 - RNA, 19 nt, Homo sapiens
uuuguagccacuucacuuu

SEQ ID NO: 47031 - RNA, 22 nt, Homo sapiens
uuugugaagcaaaauuuuuucu

SEQ ID NO: 47032 - RNA, 16 nt, Homo sapiens
uuugugacuuuccuaa

SEQ ID NO: 47033 - RNA, 14 nt, Homo sapiens
uuugugauugccau

SEQ ID NO: 47034 - RNA, 17 nt, Homo sapiens
uuugugggaaauccaca

SEQ ID NO: 47035 - RNA, 18 nt, Homo sapiens
uuuguuauuuuuccccaa

SEQ ID NO: 47036 - RNA, 19 nt, Homo sapiens
uuuuaagaaaaaggaugca

SEQ ID NO: 47037 - RNA, 21 nt, Homo sapiens
uuuuaagaaaaaggaugcaca

SEQ ID NO: 47038 - RNA, 14 nt, Homo sapiens
uuuuaaggcauauu

SEQ ID NO: 47039 - RNA, 23 nt, Homo sapiens
uuuuaaggcauauuuaacaaaau

SEQ ID NO: 47040 - RNA, 15 nt, Homo sapiens
uuuuaaguaauuuca

SEQ ID NO: 47041 - RNA, 21 nt, Homo sapiens
uuuuagaagauucuauguuaa

SEQ ID NO: 47042 - RNA, 20 nt, Homo sapiens
uuuuagucuaauugaauccc

SEQ ID NO: 47043 - RNA, 20 nt, Homo sapiens
uuuuauggaggcuuugcaua

SEQ ID NO: 47044 - RNA, 19 nt, Homo sapiens
uuuucacaaagaacaggaa

SEQ ID NO: 47045 - RNA, 20 nt, Homo sapiens
uuuucacaaagaacaggaaa

SEQ ID NO: 47046 - RNA, 14 nt, Homo sapiens
uuuucauuaucuca

SEQ ID NO: 47047 - RNA, 15 nt, Homo sapiens
uuuucccucuucacu

SEQ ID NO: 47048 - RNA, 13 nt, Homo sapiens
uuuuccuucucau

SEQ ID NO: 47049 - RNA, 23 nt, Homo sapiens
uuuucucaauguuuagcagauuu

SEQ ID NO: 47050 - RNA, 20 nt, Homo sapiens
uuuugaagauucuauguuaa

SEQ ID NO: 47051 - RNA, 21 nt, Homo sapiens
uuuugguugcuuuaauaucau

SEQ ID NO: 47052 - RNA, 21 nt, Homo sapiens
uuuuuaaacaaaaaaagcauu

SEQ ID NO: 47053 - RNA, 20 nt, Homo sapiens
uuuuuauggaggcuuugcau

SEQ ID NO: 47054 - RNA, 16 nt, Homo sapiens
uuuuuaugugcaauaa

SEQ ID NO: 47055 - RNA, 13 nt, Homo sapiens
uuuuucauuauug

SEQ ID NO: 47056 - RNA, 11 nt, Homo sapiens
uuuuuuaaaaa

SEQ ID NO: 47057 - RNA, 12 nt, Homo sapiens
uuuuuuaaaaaa

SEQ ID NO: 47058 - RNA, 13 nt, Homo sapiens
aauuggagcucgu

SEQ ID NO: 47059 - RNA, 14 nt, Homo sapiens
aauuggagcucgug

SEQ ID NO: 47060 - RNA, 18 nt, Homo sapiens
aauuuaaacgugauuuuu

SEQ ID NO: 47061 - RNA, 15 nt, Homo sapiens
aauuuaaauagcuuu

SEQ ID NO: 47062 - RNA, 15 nt, Homo sapiens
aauuuaguauuuugu

SEQ ID NO: 47063 - RNA, 20 nt, Homo sapiens
aauuuaucuugucucugggc

SEQ ID NO: 47064 - RNA, 19 nt, Homo sapiens
aauuucauaccuaucaucu

SEQ ID NO: 47065 - RNA, 21 nt, Homo sapiens
aauuucauaccuaucaucuua

SEQ ID NO: 47066 - RNA, 19 nt, Homo sapiens
aauuuccugggagcuuuug

SEQ ID NO: 47067 - RNA, 10 nt, Homo sapiens
aauuuccuua

SEQ ID NO: 47068 - RNA, 18 nt, Homo sapiens
aauuuccuuacucuugau

SEQ ID NO: 47069 - RNA, 16 nt, Homo sapiens
aauuucuaggacugaa

SEQ ID NO: 47070 - RNA, 15 nt, Homo sapiens
aauuucucccaguca

SEQ ID NO: 47071 - RNA, 20 nt, Homo sapiens
aauuucucccagucauuuaa

SEQ ID NO: 47072 - RNA, 23 nt, Homo sapiens
aauuugguuuucacauuggaaac

SEQ ID NO: 47073 - RNA, 19 nt, Homo sapiens
aauuuuaaggcauauuuaa

SEQ ID NO: 47074 - RNA, 14 nt, Homo sapiens
aauuuuaguuguca

SEQ ID NO: 47075 - RNA, 21 nt, Homo sapiens
aauuuucaaaaucaaauucca

SEQ ID NO: 47076 - RNA, 20 nt, Homo sapiens
aauuuucuucuugguucuga

SEQ ID NO: 47077 - RNA, 17 nt, Homo sapiens
aauuuuuauauuugaaa

SEQ ID NO: 47078 - RNA, 21 nt, Homo sapiens
aauuuuucucuaacucagaaa

SEQ ID NO: 47079 - RNA, 19 nt, Homo sapiens
aauuuuuucucuaggaaau

SEQ ID NO: 47080 - RNA, 21 nt, Homo sapiens
acaaaaaaagcauuguaacuu

SEQ ID NO: 47081 - RNA, 13 nt, Homo sapiens
acaaaaacacagc

SEQ ID NO: 47082 - RNA, 15 nt, Homo sapiens
acaaaaagcuacuua

SEQ ID NO: 47083 - RNA, 17 nt, Homo sapiens
acaaaaauuagccgggc

SEQ ID NO: 47084 - RNA, 18 nt, Homo sapiens
acaaaaauuagccgggca

SEQ ID NO: 47085 - RNA, 20 nt, Homo sapiens
acaaaauggaauacucuuau

SEQ ID NO: 47086 - RNA, 17 nt, Homo sapiens
acaaaccucaagccagc

SEQ ID NO: 47087 - RNA, 13 nt, Homo sapiens
acaaacucaucca

SEQ ID NO: 47088 - RNA, 12 nt, Homo sapiens
acaaagacaaau

SEQ ID NO: 47089 - RNA, 19 nt, Homo sapiens
acaaauuuacagagacaga

SEQ ID NO: 47090 - RNA, 12 nt, Homo sapiens
acaacaaaagcg

SEQ ID NO: 47091 - RNA, 22 nt, Homo sapiens
acaacaauuauuugaagauuua

SEQ ID NO: 47092 - RNA, 20 nt, Homo sapiens
acaaccuaaauuugguucua

SEQ ID NO: 47093 - RNA, 15 nt, Homo sapiens
acaacucgaaucacu

SEQ ID NO: 47094 - RNA, 16 nt, Homo sapiens
acaacucgaaucacuc

SEQ ID NO: 47095 - RNA, 12 nt, Homo sapiens
acaacugugacu

SEQ ID NO: 47096 - RNA, 13 nt, Homo sapiens
acaacugugacug

SEQ ID NO: 47097 - RNA, 22 nt, Homo sapiens
acaagaaaugaaagcagggacu

SEQ ID NO: 47098 - RNA, 23 nt, Homo sapiens
acaagaaaugaaagcagggacuu

SEQ ID NO: 47099 - RNA, 19 nt, Homo sapiens
acaagacccaaaaggcaga

SEQ ID NO: 47100 - RNA, 22 nt, Homo sapiens
acaagcaggcucaacauaacau

SEQ ID NO: 47101 - RNA, 21 nt, Homo sapiens
acaaggaugaauuaaguuuuu

SEQ ID NO: 47102 - RNA, 18 nt, Homo sapiens
acaaggcuuuaucucagg

SEQ ID NO: 47103 - RNA, 18 nt, Homo sapiens
acaauuauaucaguccuc

SEQ ID NO: 47104 - RNA, 20 nt, Homo sapiens
acaauuauuugaagauuuaa

SEQ ID NO: 47105 - RNA, 16 nt, Homo sapiens
acacacucaaaucaag

SEQ ID NO: 47106 - RNA, 15 nt, Homo sapiens
acacacugaagaagc

SEQ ID NO: 47107 - RNA, 22 nt, Homo sapiens
acacagcaagggugaugggaaa

SEQ ID NO: 47108 - RNA, 13 nt, Homo sapiens
acacagugucugg

SEQ ID NO: 47109 - RNA, 14 nt, Homo sapiens
acacaugauccugc

SEQ ID NO: 47110 - RNA, 15 nt, Homo sapiens
acacaugauccugca

SEQ ID NO: 47111 - RNA, 23 nt, Homo sapiens
acaccaauauucauagcagcuua

SEQ ID NO: 47112 - RNA, 20 nt, Homo sapiens
acaccaccacccuugccaug

SEQ ID NO: 47113 - RNA, 13 nt, Homo sapiens
acaccaggauuua

SEQ ID NO: 47114 - RNA, 18 nt, Homo sapiens
acaccaggauuuaaguuu

SEQ ID NO: 47115 - RNA, 19 nt, Homo sapiens
acaccagggccuggcuggg

SEQ ID NO: 47116 - RNA, 23 nt, Homo sapiens
acaccauuccuucugcccugcuu

SEQ ID NO: 47117 - RNA, 14 nt, Homo sapiens
acaccucagcugcc

SEQ ID NO: 47118 - RNA, 18 nt, Homo sapiens
acaccucagcugccuccc

SEQ ID NO: 47119 - RNA, 19 nt, Homo sapiens
acaccucagcugccucccc

SEQ ID NO: 47120 - RNA, 12 nt, Homo sapiens
acacgagcaggc

SEQ ID NO: 47121 - RNA, 20 nt, Homo sapiens
acacgagcaggcuacuguca

SEQ ID NO: 47122 - RNA, 18 nt, Homo sapiens
acacuaaaaaggcaugua

SEQ ID NO: 47123 - RNA, 16 nt, Homo sapiens
acacuaaaacaccuca

SEQ ID NO: 47124 - RNA, 20 nt, Homo sapiens
acacuaaaacaccucagcug

SEQ ID NO: 47125 - RNA, 16 nt, Homo sapiens
acacucaaaucaagaa

SEQ ID NO: 47126 - RNA, 20 nt, Homo sapiens
acacuccaauuaaggauuuu

SEQ ID NO: 47127 - RNA, 16 nt, Homo sapiens
acacugaagaagcacc

SEQ ID NO: 47128 - RNA, 19 nt, Homo sapiens
acacugcauguuugugauu

SEQ ID NO: 47129 - RNA, 9 nt, Homo sapiens
acacugucc

SEQ ID NO: 47130 - RNA, 17 nt, Homo sapiens
acacuguccuauuauau

SEQ ID NO: 47131 - RNA, 16 nt, Homo sapiens
acacuguuaucuucac

SEQ ID NO: 47132 - RNA, 19 nt, Homo sapiens
acacuguuaucuucacuuu

SEQ ID NO: 47133 - RNA, 13 nt, Homo sapiens
acacuguuucaaa

SEQ ID NO: 47134 - RNA, 14 nt, Homo sapiens
acacuuauaaguga

SEQ ID NO: 47135 - RNA, 13 nt, Homo sapiens
acagaacuaugga

SEQ ID NO: 47136 - RNA, 23 nt, Homo sapiens
acagaagagugacauguuuacaa

SEQ ID NO: 47137 - RNA, 11 nt, Homo sapiens
acagaagcucc

SEQ ID NO: 47138 - RNA, 13 nt, Homo sapiens
acagaagcuccag

SEQ ID NO: 47139 - RNA, 21 nt, Homo sapiens
acagacuuuuuuuuuuuuuua

SEQ ID NO: 47140 - RNA, 17 nt, Homo sapiens
acagagaaaagacauaa

SEQ ID NO: 47141 - RNA, 10 nt, Homo sapiens
acagagacag

SEQ ID NO: 47142 - RNA, 11 nt, Homo sapiens
acagagacaga

SEQ ID NO: 47143 - RNA, 13 nt, Homo sapiens
acagaggaucugc

SEQ ID NO: 47144 - RNA, 15 nt, Homo sapiens
acagaggaucugcuu

SEQ ID NO: 47145 - RNA, 13 nt, Homo sapiens
acagauaccucuc

SEQ ID NO: 47146 - RNA, 20 nt, Homo sapiens
acagccagacuggcacaguu

SEQ ID NO: 47147 - RNA, 19 nt, Homo sapiens
acagccaggcggcuggaau

SEQ ID NO: 47148 - RNA, 18 nt, Homo sapiens
acagcccaagggugggug

SEQ ID NO: 47149 - RNA, 16 nt, Homo sapiens
acagccucuuagaugc

SEQ ID NO: 47150 - RNA, 17 nt, Homo sapiens
acagccucuuagaugca

SEQ ID NO: 47151 - RNA, 17 nt, Homo sapiens
acagcuccaccuuacuu

SEQ ID NO: 47152 - RNA, 11 nt, Homo sapiens
acagcucugca

SEQ ID NO: 47153 - RNA, 21 nt, Homo sapiens
acagcucugcauacucauuag

SEQ ID NO: 47154 - RNA, 19 nt, Homo sapiens
acaggaaguagaggaggcc

SEQ ID NO: 47155 - RNA, 23 nt, Homo sapiens
acaggaaguagaggaggccacgu

SEQ ID NO: 47156 - RNA, 14 nt, Homo sapiens
acaggaauuuucau

SEQ ID NO: 47157 - RNA, 21 nt, Homo sapiens
acaggaauuuucauuguucua

SEQ ID NO: 47158 - RNA, 20 nt, Homo sapiens
acaggauggcaggaggcauc

SEQ ID NO: 47159 - RNA, 23 nt, Homo sapiens
acaggaugguucccuugaugaag

SEQ ID NO: 47160 - RNA, 17 nt, Homo sapiens
acaggcaaauuccugac

SEQ ID NO: 47161 - RNA, 10 nt, Homo sapiens
acaggcguga

SEQ ID NO: 47162 - RNA, 11 nt, Homo sapiens
acaggcgugag

SEQ ID NO: 47163 - RNA, 15 nt, Homo sapiens
acaggcgugagccac

SEQ ID NO: 47164 - RNA, 16 nt, Homo sapiens
acaggcgugagccacc

SEQ ID NO: 47165 - RNA, 18 nt, Homo sapiens
acaggcgugagccaccaa

SEQ ID NO: 47166 - RNA, 20 nt, Homo sapiens
acaggcuccaaacuggagcu

SEQ ID NO: 47167 - RNA, 13 nt, Homo sapiens
acaggggagaacc

SEQ ID NO: 47168 - RNA, 14 nt, Homo sapiens
acagucacauucca

SEQ ID NO: 47169 - RNA, 15 nt, Homo sapiens
acagucacauuccaa

SEQ ID NO: 47170 - RNA, 13 nt, Homo sapiens
acagucucaggaa

SEQ ID NO: 47171 - RNA, 20 nt, Homo sapiens
acagucucaggaaaucaaau

SEQ ID NO: 47172 - RNA, 19 nt, Homo sapiens
acagugauuaccagggacu

SEQ ID NO: 47173 - RNA, 20 nt, Homo sapiens
acagugucuggcacuuggga

SEQ ID NO: 47174 - RNA, 17 nt, Homo sapiens
acaguuacucagaauuc

SEQ ID NO: 47175 - RNA, 19 nt, Homo sapiens
acaguuccugagaccagcc

SEQ ID NO: 47176 - RNA, 20 nt, Homo sapiens
acaguuccugagaccagcca

SEQ ID NO: 47177 - RNA, 16 nt, Homo sapiens
acaguuuucugagaaa

SEQ ID NO: 47178 - RNA, 19 nt, Homo sapiens
acaguuuucugagaaagac

SEQ ID NO: 47179 - RNA, 19 nt, Homo sapiens
acaguuuugguugcuuuaa

SEQ ID NO: 47180 - RNA, 21 nt, Homo sapiens
acaguuuugguugcuuuaaua

SEQ ID NO: 47181 - RNA, 19 nt, Homo sapiens
acauaagcaaagacuauga

SEQ ID NO: 47182 - RNA, 17 nt, Homo sapiens
acauaaggaaacugggu

SEQ ID NO: 47183 - RNA, 17 nt, Homo sapiens
acauaaugcgugcauac

SEQ ID NO: 47184 - RNA, 12 nt, Homo sapiens
acauacaauuau

SEQ ID NO: 47185 - RNA, 21 nt, Homo sapiens
acauacuauagauucuuuauu

SEQ ID NO: 47186 - RNA, 11 nt, Homo sapiens
acauacugcug

SEQ ID NO: 47187 - RNA, 20 nt, Homo sapiens
acauagaauuaacacaugau

SEQ ID NO: 47188 - RNA, 13 nt, Homo sapiens
acauagcaucuca

SEQ ID NO: 47189 - RNA, 22 nt, Homo sapiens
acauauauaacaaugcuguauu

SEQ ID NO: 47190 - RNA, 15 nt, Homo sapiens
acaucaacagauaaa

SEQ ID NO: 47191 - RNA, 18 nt, Homo sapiens
acaucagcuugcccuguu

SEQ ID NO: 47192 - RNA, 18 nt, Homo sapiens
acaucaguuacucugaag

SEQ ID NO: 47193 - RNA, 15 nt, Homo sapiens
acaucuagugagcag

SEQ ID NO: 47194 - RNA, 13 nt, Homo sapiens
acaucuuucacau

SEQ ID NO: 47195 - RNA, 20 nt, Homo sapiens
acaugagagacagcaggucu

SEQ ID NO: 47196 - RNA, 10 nt, Homo sapiens
acaugggaca

SEQ ID NO: 47197 - RNA, 16 nt, Homo sapiens
acaugggacauuugcu

SEQ ID NO: 47198 - RNA, 14 nt, Homo sapiens
acaugggccccaga

SEQ ID NO: 47199 - RNA, 16 nt, Homo sapiens
acaugucagccacugu

SEQ ID NO: 47200 - RNA, 18 nt, Homo sapiens
acaugucagccacuguga

SEQ ID NO: 47201 - RNA, 20 nt, Homo sapiens
acauuacaguuagagauuuu

SEQ ID NO: 47202 - RNA, 17 nt, Homo sapiens
acauuauuggacuucca

SEQ ID NO: 47203 - RNA, 24 nt, Homo sapiens
acauuccugaacaggauauucuca

SEQ ID NO: 47204 - RNA, 14 nt, Homo sapiens
acauuucucauguu

SEQ ID NO: 47205 - RNA, 18 nt, Homo sapiens
acauuugcucauggaauu

SEQ ID NO: 47206 - RNA, 16 nt, Homo sapiens
acauuuuaugucuuuc

SEQ ID NO: 47207 - RNA, 23 nt, Homo sapiens
acauuuuuaagugcugcauuuaa

SEQ ID NO: 47208 - RNA, 13 nt, Homo sapiens
acauuuuuuuuuu

SEQ ID NO: 47209 - RNA, 20 nt, Homo sapiens
acauuuuuuuuuucaauaaa

SEQ ID NO: 47210 - RNA, 17 nt, Homo sapiens
accaaaaaucucaauau

SEQ ID NO: 47211 - RNA, 17 nt, Homo sapiens
accaaaccagagccuga

SEQ ID NO: 47212 - RNA, 20 nt, Homo sapiens
accaaacccggccugauuaa

SEQ ID NO: 47213 - RNA, 18 nt, Homo sapiens
accaaggcccccgggccg

SEQ ID NO: 47214 - RNA, 19 nt, Homo sapiens
accaaggcccccgggccga

SEQ ID NO: 47215 - RNA, 20 nt, Homo sapiens
accaaggcccccgggccgac

SEQ ID NO: 47216 - RNA, 23 nt, Homo sapiens
accaaggcccccgggccgacgga

SEQ ID NO: 47217 - RNA, 20 nt, Homo sapiens
accaauauuguacaguuuuu

SEQ ID NO: 47218 - RNA, 12 nt, Homo sapiens
accacagacaua

SEQ ID NO: 47219 - RNA, 20 nt, Homo sapiens
accacagcaguugaaaagac

SEQ ID NO: 47220 - RNA, 12 nt, Homo sapiens
accacauggcuu

SEQ ID NO: 47221 - RNA, 19 nt, Homo sapiens
accaccacccuugccaugg

SEQ ID NO: 47222 - RNA, 12 nt, Homo sapiens
accaccuuucag

SEQ ID NO: 47223 - RNA, 12 nt, Homo sapiens
accacugcagaa

SEQ ID NO: 47224 - RNA, 20 nt, Homo sapiens
accacugcagaagacaguau

SEQ ID NO: 47225 - RNA, 16 nt, Homo sapiens
accacuuuuugcagcu

SEQ ID NO: 47226 - RNA, 17 nt, Homo sapiens
accacuuuuugcagcuu

SEQ ID NO: 47227 - RNA, 18 nt, Homo sapiens
accacuuuuugcagcuuu

SEQ ID NO: 47228 - RNA, 19 nt, Homo sapiens
accagagauaauaugagaa

SEQ ID NO: 47229 - RNA, 14 nt, Homo sapiens
accagccaaccugg

SEQ ID NO: 47230 - RNA, 21 nt, Homo sapiens
accagcccuacaccauuccuu

SEQ ID NO: 47231 - RNA, 11 nt, Homo sapiens
accagccuggu

SEQ ID NO: 47232 - RNA, 14 nt, Homo sapiens
accaggcaccccca

SEQ ID NO: 47233 - RNA, 12 nt, Homo sapiens
accagggagccc

SEQ ID NO: 47234 - RNA, 19 nt, Homo sapiens
accaguaacggaacaguau

SEQ ID NO: 47235 - RNA, 16 nt, Homo sapiens
accagucugacuguuu

SEQ ID NO: 47236 - RNA, 22 nt, Homo sapiens
accagucugacuguuuccauca

SEQ ID NO: 47237 - RNA, 13 nt, Homo sapiens
accauaauucugg

SEQ ID NO: 47238 - RNA, 12 nt, Homo sapiens
accaucccggcc

SEQ ID NO: 47239 - RNA, 16 nt, Homo sapiens
accaucccggccggcg

SEQ ID NO: 47240 - RNA, 20 nt, Homo sapiens
accaucccggccggcgcgcu

SEQ ID NO: 47241 - RNA, 14 nt, Homo sapiens
accaugccauuuaa

SEQ ID NO: 47242 - RNA, 19 nt, Homo sapiens
accauuuuugaaaccaaac

SEQ ID NO: 47243 - RNA, 14 nt, Homo sapiens
acccaaaaggcaga

SEQ ID NO: 47244 - RNA, 17 nt, Homo sapiens
acccaaauguucaucaa

SEQ ID NO: 47245 - RNA, 19 nt, Homo sapiens
acccauauuuguacaccaa

SEQ ID NO: 47246 - RNA, 20 nt, Homo sapiens
accccagacgaugucuucau

SEQ ID NO: 47247 - RNA, 22 nt, Homo sapiens
accccagggcuugugugcacau

SEQ ID NO: 47248 - RNA, 23 nt, Homo sapiens
accccagggcuugugugcacaua

SEQ ID NO: 47249 - RNA, 14 nt, Homo sapiens
accccaucauccuc

SEQ ID NO: 47250 - RNA, 15 nt, Homo sapiens
acccgcccaccgcag

SEQ ID NO: 47251 - RNA, 11 nt, Homo sapiens
acccgggaggc

SEQ ID NO: 47252 - RNA, 13 nt, Homo sapiens
acccgggaggcag

SEQ ID NO: 47253 - RNA, 14 nt, Homo sapiens
acccgggaggcaga

SEQ ID NO: 47254 - RNA, 17 nt, Homo sapiens
acccucaagacaaauga

SEQ ID NO: 47255 - RNA, 13 nt, Homo sapiens
acccucaugcugc

SEQ ID NO: 47256 - RNA, 14 nt, Homo sapiens
acccucaugcugcc

SEQ ID NO: 47257 - RNA, 14 nt, Homo sapiens
acccucugggucuc

SEQ ID NO: 47258 - RNA, 15 nt, Homo sapiens
acccucugggucuca

SEQ ID NO: 47259 - RNA, 22 nt, Homo sapiens
acccucugggucucaguguccu

SEQ ID NO: 47260 - RNA, 13 nt, Homo sapiens
acccuugccaugg

SEQ ID NO: 47261 - RNA, 22 nt, Homo sapiens
accgcagggugaacugcagcga

SEQ ID NO: 47262 - RNA, 13 nt, Homo sapiens
accgcuguacgcg

SEQ ID NO: 47263 - RNA, 18 nt, Homo sapiens
accgcuguacgcgagcgc

SEQ ID NO: 47264 - RNA, 20 nt, Homo sapiens
accgcuguacgcgagcgcgc

SEQ ID NO: 47265 - RNA, 21 nt, Homo sapiens
accgcuguacgcgagcgcgcg

SEQ ID NO: 47266 - RNA, 23 nt, Homo sapiens
accgcuguacgcgagcgcgcgcg

SEQ ID NO: 47267 - RNA, 20 nt, Homo sapiens
accucccaacgucccuagcc

SEQ ID NO: 47268 - RNA, 22 nt, Homo sapiens
accuccugccuaagugcagccc

SEQ ID NO: 47269 - RNA, 13 nt, Homo sapiens
accuccugccuca

SEQ ID NO: 47270 - RNA, 18 nt, Homo sapiens
accucuaaauucuuucau

SEQ ID NO: 47271 - RNA, 13 nt, Homo sapiens
accucucaccucc

SEQ ID NO: 47272 - RNA, 15 nt, Homo sapiens
accucuccagccuca

SEQ ID NO: 47273 - RNA, 22 nt, Homo sapiens
accucuccagccucagcucuca

SEQ ID NO: 47274 - RNA, 12 nt, Homo sapiens
accucuccauga

SEQ ID NO: 47275 - RNA, 14 nt, Homo sapiens
accucuccaugauc

SEQ ID NO: 47276 - RNA, 22 nt, Homo sapiens
accucuccaugaucccaccucc

SEQ ID NO: 47277 - RNA, 18 nt, Homo sapiens
accucucccaacuauaaa

SEQ ID NO: 47278 - RNA, 17 nt, Homo sapiens
accucuugagccuugaa

SEQ ID NO: 47279 - RNA, 9 nt, Homo sapiens
accugagcc

SEQ ID NO: 47280 - RNA, 11 nt, Homo sapiens
accugagcccc

SEQ ID NO: 47281 - RNA, 12 nt, Homo sapiens
accugagcccca

SEQ ID NO: 47282 - RNA, 11 nt, Homo sapiens
accugcaggcg

SEQ ID NO: 47283 - RNA, 14 nt, Homo sapiens
accugcuucuauua

SEQ ID NO: 47284 - RNA, 21 nt, Homo sapiens
accugcuucuauuagcccuuc

SEQ ID NO: 47285 - RNA, 15 nt, Homo sapiens
accuggaauauauaa

SEQ ID NO: 47286 - RNA, 20 nt, Homo sapiens
accugggaaagggcuguuau

SEQ ID NO: 47287 - RNA, 21 nt, Homo sapiens
accugggaaagggcuguuaua

SEQ ID NO: 47288 - RNA, 20 nt, Homo sapiens
accugggccauagucauucu

SEQ ID NO: 47289 - RNA, 14 nt, Homo sapiens
accuguaaucccag

SEQ ID NO: 47290 - RNA, 15 nt, Homo sapiens
accuguaaucccagc

SEQ ID NO: 47291 - RNA, 12 nt, Homo sapiens
accuguccccga

SEQ ID NO: 47292 - RNA, 13 nt, Homo sapiens
accuguccccgaa

SEQ ID NO: 47293 - RNA, 15 nt, Homo sapiens
accuguccccgaaac

SEQ ID NO: 47294 - RNA, 14 nt, Homo sapiens
accugugagaccaa

SEQ ID NO: 47295 - RNA, 19 nt, Homo sapiens
accuguggccaaguucuua

SEQ ID NO: 47296 - RNA, 13 nt, Homo sapiens
accuguucgcgcg

SEQ ID NO: 47297 - RNA, 14 nt, Homo sapiens
accuguucgcgcgc

SEQ ID NO: 47298 - RNA, 17 nt, Homo sapiens
accuguucgcgcgccuc

SEQ ID NO: 47299 - RNA, 18 nt, Homo sapiens
accuguucgcgcgccucc

SEQ ID NO: 47300 - RNA, 20 nt, Homo sapiens
accuguucgcgcgccuccgc

SEQ ID NO: 47301 - RNA, 19 nt, Homo sapiens
accuguuuuuaagcuguuu

SEQ ID NO: 47302 - RNA, 16 nt, Homo sapiens
accuuacuucuucuca

SEQ ID NO: 47303 - RNA, 17 nt, Homo sapiens
accuuauuguaccucuc

SEQ ID NO: 47304 - RNA, 16 nt, Homo sapiens
accuucucaccuguga

SEQ ID NO: 47305 - RNA, 13 nt, Homo sapiens
accuucuggguuc

SEQ ID NO: 47306 - RNA, 14 nt, Homo sapiens
accuucuggguuca

SEQ ID NO: 47307 - RNA, 20 nt, Homo sapiens
accuuucagauaacuguuau

SEQ ID NO: 47308 - RNA, 21 nt, Homo sapiens
accuuucagauaacuguuauu

SEQ ID NO: 47309 - RNA, 22 nt, Homo sapiens
accuuucagauaacuguuauuu

SEQ ID NO: 47310 - RNA, 17 nt, Homo sapiens
accuuuggaugcacuuu

SEQ ID NO: 47311 - RNA, 19 nt, Homo sapiens
accuuuggaugcacuuuau

SEQ ID NO: 47312 - RNA, 15 nt, Homo sapiens
acgaaaaacauuuca

SEQ ID NO: 47313 - RNA, 23 nt, Homo sapiens
acgaaguauccuucagccugaaa

SEQ ID NO: 47314 - RNA, 17 nt, Homo sapiens
acgcauggaaaaguuuc

SEQ ID NO: 47315 - RNA, 16 nt, Homo sapiens
acgccuguaaucccag

SEQ ID NO: 47316 - RNA, 16 nt, Homo sapiens
acgcgagcgcgcgcgc

SEQ ID NO: 47317 - RNA, 17 nt, Homo sapiens
acgcgagcgcgcgcgcc

SEQ ID NO: 47318 - RNA, 18 nt, Homo sapiens
acgcgagcgcgcgcgccc

SEQ ID NO: 47319 - RNA, 19 nt, Homo sapiens
acgcgagcgcgcgcgcccu

SEQ ID NO: 47320 - RNA, 20 nt, Homo sapiens
acgcgagcgcgcgcgcccuc

SEQ ID NO: 47321 - RNA, 13 nt, Homo sapiens
acgcgcgcuccgc

SEQ ID NO: 47322 - RNA, 14 nt, Homo sapiens
acgcgcgcuccgcg

SEQ ID NO: 47323 - RNA, 15 nt, Homo sapiens
acgcgcgcuccgcgc

SEQ ID NO: 47324 - RNA, 16 nt, Homo sapiens
acgcgcgcuccgcgca

SEQ ID NO: 47325 - RNA, 17 nt, Homo sapiens
acgcgcgcuccgcgcag

SEQ ID NO: 47326 - RNA, 19 nt, Homo sapiens
acgcgcgcuccgcgcagcu

SEQ ID NO: 47327 - RNA, 20 nt, Homo sapiens
acgcgcgcuccgcgcagcuc

SEQ ID NO: 47328 - RNA, 17 nt, Homo sapiens
acgcucugggucgccgg

SEQ ID NO: 47329 - RNA, 19 nt, Homo sapiens
acgcucugggucgccggca

SEQ ID NO: 47330 - RNA, 20 nt, Homo sapiens
acgcucugggucgccggcau

SEQ ID NO: 47331 - RNA, 21 nt, Homo sapiens
acgcucugggucgccggcauc

SEQ ID NO: 47332 - RNA, 20 nt, Homo sapiens
acggagauaucccaggaaaa

SEQ ID NO: 47333 - RNA, 12 nt, Homo sapiens
acggagccggga

SEQ ID NO: 47334 - RNA, 11 nt, Homo sapiens
acggcuccgga

SEQ ID NO: 47335 - RNA, 18 nt, Homo sapiens
acggcuccggacgcugcu

SEQ ID NO: 47336 - RNA, 22 nt, Homo sapiens
acggcuccggacgcugcugccg

SEQ ID NO: 47337 - RNA, 15 nt, Homo sapiens
acggcuggagcugcc

SEQ ID NO: 47338 - RNA, 19 nt, Homo sapiens
acgucccuagcccuuacgu

SEQ ID NO: 47339 - RNA, 14 nt, Homo sapiens
acgucuuaaauauu

SEQ ID NO: 47340 - RNA, 11 nt, Homo sapiens
acgugacuggc

SEQ ID NO: 47341 - RNA, 14 nt, Homo sapiens
acgugacuggccug

SEQ ID NO: 47342 - RNA, 20 nt, Homo sapiens
acgugacuggccugcuggau

SEQ ID NO: 47343 - RNA, 16 nt, Homo sapiens
acgugauuuuuaaauu

SEQ ID NO: 47344 - RNA, 17 nt, Homo sapiens
acgugauuuuuaaauua

SEQ ID NO: 47345 - RNA, 10 nt, Homo sapiens
acgugcaaua

SEQ ID NO: 47346 - RNA, 11 nt, Homo sapiens
acgugcaauac

SEQ ID NO: 47347 - RNA, 15 nt, Homo sapiens
acgugggcauucaaa

SEQ ID NO: 47348 - RNA, 22 nt, Homo sapiens
acguuucuaaaggcuaccuuug

SEQ ID NO: 47349 - RNA, 14 nt, Homo sapiens
acuaaaauguucua

SEQ ID NO: 47350 - RNA, 20 nt, Homo sapiens
acuaauagaauuaauggaau

SEQ ID NO: 47351 - RNA, 14 nt, Homo sapiens
acuaauuaggcaag

SEQ ID NO: 47352 - RNA, 21 nt, Homo sapiens
acuagaguuuagcuggaaaag

SEQ ID NO: 47353 - RNA, 12 nt, Homo sapiens
acuagucuuaua

SEQ ID NO: 47354 - RNA, 17 nt, Homo sapiens
acuaguuguaauuuuuu

SEQ ID NO: 47355 - RNA, 14 nt, Homo sapiens
acuauaaaacuagg

SEQ ID NO: 47356 - RNA, 15 nt, Homo sapiens
acuaucucauuucca

SEQ ID NO: 47357 - RNA, 15 nt, Homo sapiens
acuauucaaacaguc

SEQ ID NO: 47358 - RNA, 22 nt, Homo sapiens
acuauuuaagagaacaagcaaa

SEQ ID NO: 47359 - RNA, 14 nt, Homo sapiens
acucagaaacauca

SEQ ID NO: 47360 - RNA, 22 nt, Homo sapiens
acucagaauucucuaguuugau

SEQ ID NO: 47361 - RNA, 12 nt, Homo sapiens
acucauugcaac

SEQ ID NO: 47362 - RNA, 19 nt, Homo sapiens
acucauugcaaccuccacc

SEQ ID NO: 47363 - RNA, 23 nt, Homo sapiens
acucauugcaaccuccaccuucu

SEQ ID NO: 47364 - RNA, 17 nt, Homo sapiens
acucauuuuuguuuuca

SEQ ID NO: 47365 - RNA, 22 nt, Homo sapiens
acuccaaagaaauguaagggaa

SEQ ID NO: 47366 - RNA, 20 nt, Homo sapiens
acuccacuuggacaugggcc

SEQ ID NO: 47367 - RNA, 13 nt, Homo sapiens
acuccagccuggg

SEQ ID NO: 47368 - RNA, 14 nt, Homo sapiens
acuccagccugggu

SEQ ID NO: 47369 - RNA, 21 nt, Homo sapiens
acuccugguuccuaggugagc

SEQ ID NO: 47370 - RNA, 22 nt, Homo sapiens
acuccugguuccuaggugagca

SEQ ID NO: 47371 - RNA, 22 nt, Homo sapiens
acucuacaaaauauagcuuuca

SEQ ID NO: 47372 - RNA, 19 nt, Homo sapiens
acucugaaggguaauuaua

SEQ ID NO: 47373 - RNA, 19 nt, Homo sapiens
acucuggucaagaagcauc

SEQ ID NO: 47374 - RNA, 21 nt, Homo sapiens
acucuuaagaagacugcauua

SEQ ID NO: 47375 - RNA, 15 nt, Homo sapiens
acugaaauaaacguc

SEQ ID NO: 47376 - RNA, 14 nt, Homo sapiens
acugaacauuccag

SEQ ID NO: 47377 - RNA, 13 nt, Homo sapiens
acugacaacuuga

SEQ ID NO: 47378 - RNA, 15 nt, Homo sapiens
acugacucuuaagaa

SEQ ID NO: 47379 - RNA, 17 nt, Homo sapiens
acugagcuucucuguga

SEQ ID NO: 47380 - RNA, 19 nt, Homo sapiens
acugaguacguugugcauu

SEQ ID NO: 47381 - RNA, 15 nt, Homo sapiens
acugcacugucaaga

SEQ ID NO: 47382 - RNA, 16 nt, Homo sapiens
acugcacugucaagau

SEQ ID NO: 47383 - RNA, 20 nt, Homo sapiens
acugcacugucaagaugaug

SEQ ID NO: 47384 - RNA, 19 nt, Homo sapiens
acugcagcgaguacuuccc

SEQ ID NO: 47385 - RNA, 21 nt, Homo sapiens
acugcagcgaguacuucccgc

SEQ ID NO: 47386 - RNA, 14 nt, Homo sapiens
acugcauacaaucu

SEQ ID NO: 47387 - RNA, 14 nt, Homo sapiens
acugcauuauauuu

SEQ ID NO: 47388 - RNA, 15 nt, Homo sapiens
acugcauuauauuua

SEQ ID NO: 47389 - RNA, 14 nt, Homo sapiens
acugccuaucagca

SEQ ID NO: 47390 - RNA, 22 nt, Homo sapiens
acugccuucucaacuccaaacu

SEQ ID NO: 47391 - RNA, 22 nt, Homo sapiens
acuggcacaguuuucugagaaa

SEQ ID NO: 47392 - RNA, 16 nt, Homo sapiens
acuggcaguuuuccau

SEQ ID NO: 47393 - RNA, 14 nt, Homo sapiens
acuggccugcugga

SEQ ID NO: 47394 - RNA, 16 nt, Homo sapiens
acuggcucccuggaag

SEQ ID NO: 47395 - RNA, 13 nt, Homo sapiens
acuggcuguuaau

SEQ ID NO: 47396 - RNA, 9 nt, Homo sapiens
acugggaca

SEQ ID NO: 47397 - RNA, 18 nt, Homo sapiens
acugggguggguggggca

SEQ ID NO: 47398 - RNA, 19 nt, Homo sapiens
acugggguggguggggcag

SEQ ID NO: 47399 - RNA, 21 nt, Homo sapiens
acugggguggguggggcagug

SEQ ID NO: 47400 - RNA, 23 nt, Homo sapiens
acugggguggguggggcagugcu

SEQ ID NO: 47401 - RNA, 21 nt, Homo sapiens
acuguaaagcuuugugcagau

SEQ ID NO: 47402 - RNA, 22 nt, Homo sapiens
acugucaauuuggcagugauau

SEQ ID NO: 47403 - RNA, 14 nt, Homo sapiens
acugucucacuuaa

SEQ ID NO: 47404 - RNA, 12 nt, Homo sapiens
acugugacugua

SEQ ID NO: 47405 - RNA, 20 nt, Homo sapiens
acuguuuagaugaaugucag

SEQ ID NO: 47406 - RNA, 23 nt, Homo sapiens
acuuaagguuaccuuuguuccca

SEQ ID NO: 47407 - RNA, 13 nt, Homo sapiens
acuuacuguacau

SEQ ID NO: 47408 - RNA, 20 nt, Homo sapiens
acuuauaggaauugacccac

SEQ ID NO: 47409 - RNA, 14 nt, Homo sapiens
acuuauuuauauaa

SEQ ID NO: 47410 - RNA, 17 nt, Homo sapiens
acuuauuuguacauuuu

SEQ ID NO: 47411 - RNA, 18 nt, Homo sapiens
acuuauuuguacauuuuu

SEQ ID NO: 47412 - RNA, 16 nt, Homo sapiens
acuucauuaauaauaa

SEQ ID NO: 47413 - RNA, 23 nt, Homo sapiens
acuucauucuugaaagcuguggc

SEQ ID NO: 47414 - RNA, 20 nt, Homo sapiens
acuuccagggcuacgcgcgc

SEQ ID NO: 47415 - RNA, 21 nt, Homo sapiens
acuuccagggcuacgcgcgcu

SEQ ID NO: 47416 - RNA, 23 nt, Homo sapiens
acuuccagggcuacgcgcgcucc

SEQ ID NO: 47417 - RNA, 21 nt, Homo sapiens
acuucccgcuguuccucgcca

SEQ ID NO: 47418 - RNA, 17 nt, Homo sapiens
acuuccucccggccgcg

SEQ ID NO: 47419 - RNA, 21 nt, Homo sapiens
acuuccuuggacucauuuuaa

SEQ ID NO: 47420 - RNA, 19 nt, Homo sapiens
acuucuaaguaaaaccaca

SEQ ID NO: 47421 - RNA, 22 nt, Homo sapiens
acuucuaaguaaaaccacagca

SEQ ID NO: 47422 - RNA, 15 nt, Homo sapiens
acuucugucuucaca

SEQ ID NO: 47423 - RNA, 21 nt, Homo sapiens
acuucuuaguaugugcauuua

SEQ ID NO: 47424 - RNA, 15 nt, Homo sapiens
acuucuucucauacu

SEQ ID NO: 47425 - RNA, 17 nt, Homo sapiens
acuucuucucauacuau

SEQ ID NO: 47426 - RNA, 18 nt, Homo sapiens
acuugaugauacaaugaa

SEQ ID NO: 47427 - RNA, 19 nt, Homo sapiens
acuugggcgggacacaggc

SEQ ID NO: 47428 - RNA, 15 nt, Homo sapiens
acuugucaauaaaau

SEQ ID NO: 47429 - RNA, 19 nt, Homo sapiens
acuuuaacacagugucugg

SEQ ID NO: 47430 - RNA, 12 nt, Homo sapiens
acuuuaccuuuu

SEQ ID NO: 47431 - RNA, 15 nt, Homo sapiens
acuuuacugucccca

SEQ ID NO: 47432 - RNA, 15 nt, Homo sapiens
acuuuccaauaaaga

SEQ ID NO: 47433 - RNA, 13 nt, Homo sapiens
acuuugaccucug

SEQ ID NO: 47434 - RNA, 15 nt, Homo sapiens
acuuugauuuuauau

SEQ ID NO: 47435 - RNA, 12 nt, Homo sapiens
acuuugugaaaa

SEQ ID NO: 47436 - RNA, 9 nt, Homo sapiens
acuuuucca

SEQ ID NO: 47437 - RNA, 17 nt, Homo sapiens
acuuuuccaaugacauu

SEQ ID NO: 47438 - RNA, 18 nt, Homo sapiens
acuuuuccaaugacauuu

SEQ ID NO: 47439 - RNA, 19 nt, Homo sapiens
agaaaacaggcaaauuccu

SEQ ID NO: 47440 - RNA, 17 nt, Homo sapiens
agaaaauaaaagcacuu

SEQ ID NO: 47441 - RNA, 15 nt, Homo sapiens
agaaaauaucacuug

SEQ ID NO: 47442 - RNA, 21 nt, Homo sapiens
agaaaccuuauuguaccucuc

SEQ ID NO: 47443 - RNA, 14 nt, Homo sapiens
agaaauaggaaaua

SEQ ID NO: 47444 - RNA, 22 nt, Homo sapiens
agaaauuccaggaaaaucugca

SEQ ID NO: 47445 - RNA, 23 nt, Homo sapiens
agaaauuccaggaaaaucugcac

SEQ ID NO: 47446 - RNA, 16 nt, Homo sapiens
agaacaggaaaauaaa

SEQ ID NO: 47447 - RNA, 17 nt, Homo sapiens
agaacaggaaaauaaaa

SEQ ID NO: 47448 - RNA, 23 nt, Homo sapiens
agaacuuauuuguacauuuuuuu

SEQ ID NO: 47449 - RNA, 15 nt, Homo sapiens
agaagaacugaaauc

SEQ ID NO: 47450 - RNA, 12 nt, Homo sapiens
agaagagaauau

SEQ ID NO: 47451 - RNA, 12 nt, Homo sapiens
agaagagccgga

SEQ ID NO: 47452 - RNA, 14 nt, Homo sapiens
agaagagccggagc

SEQ ID NO: 47453 - RNA, 15 nt, Homo sapiens
agaagaggaaagaga

SEQ ID NO: 47454 - RNA, 17 nt, Homo sapiens
agaagaggaaagagaga

SEQ ID NO: 47455 - RNA, 22 nt, Homo sapiens
agaagauggcacuuauaaccaa

SEQ ID NO: 47456 - RNA, 17 nt, Homo sapiens
agaaggauguacauuuc

SEQ ID NO: 47457 - RNA, 20 nt, Homo sapiens
agaaggauguacauuuccaa

SEQ ID NO: 47458 - RNA, 22 nt, Homo sapiens
agaagugaaaaucuacacucca

SEQ ID NO: 47459 - RNA, 17 nt, Homo sapiens
agaaguuaagcaacauc

SEQ ID NO: 47460 - RNA, 11 nt, Homo sapiens
agaaguuuucu

SEQ ID NO: 47461 - RNA, 18 nt, Homo sapiens
agaauacuaauaaaauac

SEQ ID NO: 47462 - RNA, 18 nt, Homo sapiens
agaauauaaaaauaaagc

SEQ ID NO: 47463 - RNA, 15 nt, Homo sapiens
agaauauauuuccuu

SEQ ID NO: 47464 - RNA, 20 nt, Homo sapiens
agaauauuaaaaauuaauuc

SEQ ID NO: 47465 - RNA, 19 nt, Homo sapiens
agaauauuuauuaccucug

SEQ ID NO: 47466 - RNA, 13 nt, Homo sapiens
agaaucacuugaa

SEQ ID NO: 47467 - RNA, 14 nt, Homo sapiens
agaaucacuugaac

SEQ ID NO: 47468 - RNA, 16 nt, Homo sapiens
agaaucacuugaaccc

SEQ ID NO: 47469 - RNA, 17 nt, Homo sapiens
agaaucagaucauuuca

SEQ ID NO: 47470 - RNA, 18 nt, Homo sapiens
agaaugauuaugaauuac

SEQ ID NO: 47471 - RNA, 13 nt, Homo sapiens
agaauguuuucaa

SEQ ID NO: 47472 - RNA, 21 nt, Homo sapiens
agaauucuguugauggaaaua

SEQ ID NO: 47473 - RNA, 19 nt, Homo sapiens
agaauugcuugaacccagg

SEQ ID NO: 47474 - RNA, 23 nt, Homo sapiens
agaauuuucaaaaucaaauucca

SEQ ID NO: 47475 - RNA, 12 nt, Homo sapiens
agacaaugacuu

SEQ ID NO: 47476 - RNA, 19 nt, Homo sapiens
agacaaugacuuacuguac

SEQ ID NO: 47477 - RNA, 20 nt, Homo sapiens
agacaauuuauuauggcaca

SEQ ID NO: 47478 - RNA, 15 nt, Homo sapiens
agacacaugggugcu

SEQ ID NO: 47479 - RNA, 17 nt, Homo sapiens
agacacaugggugcuau

SEQ ID NO: 47480 - RNA, 12 nt, Homo sapiens
agacaccaccac

SEQ ID NO: 47481 - RNA, 13 nt, Homo sapiens
agacaccaccacc

SEQ ID NO: 47482 - RNA, 14 nt, Homo sapiens
agacaccaccaccc

SEQ ID NO: 47483 - RNA, 20 nt, Homo sapiens
agacaccaccacccuugcca

SEQ ID NO: 47484 - RNA, 23 nt, Homo sapiens
agacaccaccacccuugccaugg

SEQ ID NO: 47485 - RNA, 14 nt, Homo sapiens
agacagaaagcaga

SEQ ID NO: 47486 - RNA, 22 nt, Homo sapiens
agacagaaagcagaacagugau

SEQ ID NO: 47487 - RNA, 12 nt, Homo sapiens
agacagcagguc

SEQ ID NO: 47488 - RNA, 13 nt, Homo sapiens
agacagcaggucu

SEQ ID NO: 47489 - RNA, 14 nt, Homo sapiens
agacagcaggucuc

SEQ ID NO: 47490 - RNA, 17 nt, Homo sapiens
agacagcaggucucaug

SEQ ID NO: 47491 - RNA, 19 nt, Homo sapiens
agacagggaaagggucucc

SEQ ID NO: 47492 - RNA, 23 nt, Homo sapiens
agacauagaauuaacacaugauc

SEQ ID NO: 47493 - RNA, 15 nt, Homo sapiens
agacaucaacagaua

SEQ ID NO: 47494 - RNA, 21 nt, Homo sapiens
agacaugagagacagcagguc

SEQ ID NO: 47495 - RNA, 20 nt, Homo sapiens
agaccagccaaccugggggc

SEQ ID NO: 47496 - RNA, 15 nt, Homo sapiens
agacccucaugcugc

SEQ ID NO: 47497 - RNA, 17 nt, Homo sapiens
agacccucaugcugcca

SEQ ID NO: 47498 - RNA, 19 nt, Homo sapiens
agacgggguuugccaugcu

SEQ ID NO: 47499 - RNA, 21 nt, Homo sapiens
agacgggguuugccaugcugg

SEQ ID NO: 47500 - RNA, 22 nt, Homo sapiens
agacgggguuugccaugcuggc

SEQ ID NO: 47501 - RNA, 21 nt, Homo sapiens
agacgugauuuugcuguagaa

SEQ ID NO: 47502 - RNA, 22 nt, Homo sapiens
agacuaugaggaauauuugcaa

SEQ ID NO: 47503 - RNA, 17 nt, Homo sapiens
agacuauucaaacaguc

SEQ ID NO: 47504 - RNA, 13 nt, Homo sapiens
agacuccaaagaa

SEQ ID NO: 47505 - RNA, 15 nt, Homo sapiens
agacugcauuauauu

SEQ ID NO: 47506 - RNA, 14 nt, Homo sapiens
agagaaauuugcca

SEQ ID NO: 47507 - RNA, 9 nt, Homo sapiens
agagaagau

SEQ ID NO: 47508 - RNA, 20 nt, Homo sapiens
agagaagauagcagggcaug

SEQ ID NO: 47509 - RNA, 17 nt, Homo sapiens
agagaauaaaaaaugua

SEQ ID NO: 47510 - RNA, 13 nt, Homo sapiens
agagaauuuccuu

SEQ ID NO: 47511 - RNA, 23 nt, Homo sapiens
agagacagaaagcagaacaguga

SEQ ID NO: 47512 - RNA, 19 nt, Homo sapiens
agagacagcaggucucaug

SEQ ID NO: 47513 - RNA, 19 nt, Homo sapiens
agagacgggguuugccaug

SEQ ID NO: 47514 - RNA, 20 nt, Homo sapiens
agagacgggguuugccaugc

SEQ ID NO: 47515 - RNA, 12 nt, Homo sapiens
agagacuuugug

SEQ ID NO: 47516 - RNA, 19 nt, Homo sapiens
agagcaagacucugucuca

SEQ ID NO: 47517 - RNA, 20 nt, Homo sapiens
agagcaagacucugucucaa

SEQ ID NO: 47518 - RNA, 12 nt, Homo sapiens
agagcaucucau

SEQ ID NO: 47519 - RNA, 22 nt, Homo sapiens
agagcccuucaugcauuugcac

SEQ ID NO: 47520 - RNA, 23 nt, Homo sapiens
agagcccuucaugcauuugcacu

SEQ ID NO: 47521 - RNA, 11 nt, Homo sapiens
agagccggagc

SEQ ID NO: 47522 - RNA, 12 nt, Homo sapiens
agagccggagcc

SEQ ID NO: 47523 - RNA, 13 nt, Homo sapiens
agagccggagccu

SEQ ID NO: 47524 - RNA, 19 nt, Homo sapiens
agagccggagccuccagcu

SEQ ID NO: 47525 - RNA, 23 nt, Homo sapiens
agagccggagccuccagcugccc

SEQ ID NO: 47526 - RNA, 21 nt, Homo sapiens
agagccugaguguugccuaau

SEQ ID NO: 47527 - RNA, 20 nt, Homo sapiens
agagcuacaggccccaucug

SEQ ID NO: 47528 - RNA, 21 nt, Homo sapiens
agagcuacaggccccaucugg

SEQ ID NO: 47529 - RNA, 22 nt, Homo sapiens
agagucuauuuacggaacucaa

SEQ ID NO: 47530 - RNA, 16 nt, Homo sapiens
agaguggguuucacaa

SEQ ID NO: 47531 - RNA, 21 nt, Homo sapiens
agaguucugucuggacuuucc

SEQ ID NO: 47532 - RNA, 13 nt, Homo sapiens
agauaaacaguag

SEQ ID NO: 47533 - RNA, 23 nt, Homo sapiens
agauaacuguuauuuauaaucac

SEQ ID NO: 47534 - RNA, 15 nt, Homo sapiens
agauaauacaccacu

SEQ ID NO: 47535 - RNA, 14 nt, Homo sapiens
agauaauaugagaa

SEQ ID NO: 47536 - RNA, 15 nt, Homo sapiens
agauaaucacaauac

SEQ ID NO: 47537 - RNA, 19 nt, Homo sapiens
agauaaucucuccauuccc

SEQ ID NO: 47538 - RNA, 12 nt, Homo sapiens
agauaccucucu

SEQ ID NO: 47539 - RNA, 15 nt, Homo sapiens
agauaccucucuugu

SEQ ID NO: 47540 - RNA, 21 nt, Homo sapiens
agauacugaaauaaacgucuu

SEQ ID NO: 47541 - RNA, 12 nt, Homo sapiens
agauauaauuua

SEQ ID NO: 47542 - RNA, 14 nt, Homo sapiens
agauaugaggcauu

SEQ ID NO: 47543 - RNA, 15 nt, Homo sapiens
agauaugaggcauuu

SEQ ID NO: 47544 - RNA, 19 nt, Homo sapiens
agauaugauucaaaugucu

SEQ ID NO: 47545 - RNA, 22 nt, Homo sapiens
agauauuuugcuuugugauuuu

SEQ ID NO: 47546 - RNA, 13 nt, Homo sapiens
agaucaagccugc

SEQ ID NO: 47547 - RNA, 17 nt, Homo sapiens
agaucaccaucaauuuu

SEQ ID NO: 47548 - RNA, 16 nt, Homo sapiens
agauccccguguuacu

SEQ ID NO: 47549 - RNA, 14 nt, Homo sapiens
agauccuggaaauc

SEQ ID NO: 47550 - RNA, 11 nt, Homo sapiens
agaucugcaac

SEQ ID NO: 47551 - RNA, 13 nt, Homo sapiens
agaugaaugucag

SEQ ID NO: 47552 - RNA, 14 nt, Homo sapiens
agaugaaugucagu

SEQ ID NO: 47553 - RNA, 14 nt, Homo sapiens
agaugaugaugauc

SEQ ID NO: 47554 - RNA, 19 nt, Homo sapiens
agaugcaguucugaagaag

SEQ ID NO: 47555 - RNA, 13 nt, Homo sapiens
agauguagaggag

SEQ ID NO: 47556 - RNA, 16 nt, Homo sapiens
agauguauguacuuca

SEQ ID NO: 47557 - RNA, 19 nt, Homo sapiens
agaugugaacacaucagcu

SEQ ID NO: 47558 - RNA, 19 nt, Homo sapiens
agaugugggcagugauguc

SEQ ID NO: 47559 - RNA, 23 nt, Homo sapiens
agauuaagagauggguuugacaa

SEQ ID NO: 47560 - RNA, 13 nt, Homo sapiens
agauuaugaucuc

SEQ ID NO: 47561 - RNA, 18 nt, Homo sapiens
agauuguauagugcaugu

SEQ ID NO: 47562 - RNA, 13 nt, Homo sapiens
agauuuaagauau

SEQ ID NO: 47563 - RNA, 23 nt, Homo sapiens
agauuuuguuuuuaaacuggaaa

SEQ ID NO: 47564 - RNA, 20 nt, Homo sapiens
agcaaaauggauaugacaca

SEQ ID NO: 47565 - RNA, 13 nt, Homo sapiens
agcaaaaugugau

SEQ ID NO: 47566 - RNA, 14 nt, Homo sapiens
agcaaaaugugaua

SEQ ID NO: 47567 - RNA, 15 nt, Homo sapiens
agcaaauuccaauac

SEQ ID NO: 47568 - RNA, 18 nt, Homo sapiens
agcaaauuccaauacauu

SEQ ID NO: 47569 - RNA, 20 nt, Homo sapiens
agcaaauuccaauacauuau

SEQ ID NO: 47570 - RNA, 21 nt, Homo sapiens
agcaacccaaauguucaucaa

SEQ ID NO: 47571 - RNA, 18 nt, Homo sapiens
agcaagacucugucucaa

SEQ ID NO: 47572 - RNA, 14 nt, Homo sapiens
agcaagauaauaaa

SEQ ID NO: 47573 - RNA, 22 nt, Homo sapiens
agcaagaucccauggguugugu

SEQ ID NO: 47574 - RNA, 16 nt, Homo sapiens
agcaaggagauuuaca

SEQ ID NO: 47575 - RNA, 21 nt, Homo sapiens
agcaagugaauuuuucucuaa

SEQ ID NO: 47576 - RNA, 14 nt, Homo sapiens
agcacacacuuuug

SEQ ID NO: 47577 - RNA, 19 nt, Homo sapiens
agcaccuacaguguacagu

SEQ ID NO: 47578 - RNA, 23 nt, Homo sapiens
agcaccugcaggcgugaccugac

SEQ ID NO: 47579 - RNA, 24 nt, Homo sapiens
agcaccugcaggcgugaccugaca

SEQ ID NO: 47580 - RNA, 21 nt, Homo sapiens
agcacuuuaacacagugucug

SEQ ID NO: 47581 - RNA, 15 nt, Homo sapiens
agcacuuugggaggc

SEQ ID NO: 47582 - RNA, 16 nt, Homo sapiens
agcacuuugggaggcu

SEQ ID NO: 47583 - RNA, 13 nt, Homo sapiens
agcagaaaugccu

SEQ ID NO: 47584 - RNA, 15 nt, Homo sapiens
agcagaacagugauu

SEQ ID NO: 47585 - RNA, 20 nt, Homo sapiens
agcagaacagugauuaccag

SEQ ID NO: 47586 - RNA, 20 nt, Homo sapiens
agcagcguuucuaugacaca

SEQ ID NO: 47587 - RNA, 21 nt, Homo sapiens
agcagcuuauucacaagaccc

SEQ ID NO: 47588 - RNA, 19 nt, Homo sapiens
agcaggauagagugggaca

SEQ ID NO: 47589 - RNA, 16 nt, Homo sapiens
agcaggcuacugucag

SEQ ID NO: 47590 - RNA, 17 nt, Homo sapiens
agcagggacuugaaccc

SEQ ID NO: 47591 - RNA, 18 nt, Homo sapiens
agcagggacuugaaccca

SEQ ID NO: 47592 - RNA, 17 nt, Homo sapiens
agcagucaggaaagaga

SEQ ID NO: 47593 - RNA, 18 nt, Homo sapiens
agcauaccaacacgagca

SEQ ID NO: 47594 - RNA, 22 nt, Homo sapiens
agcauaccaacacgagcaggcu

SEQ ID NO: 47595 - RNA, 16 nt, Homo sapiens
agcauacguacacauu

SEQ ID NO: 47596 - RNA, 21 nt, Homo sapiens
agcauacguacacauuuuauu

SEQ ID NO: 47597 - RNA, 22 nt, Homo sapiens
agcauauguuuuuguaaguuua

SEQ ID NO: 47598 - RNA, 23 nt, Homo sapiens
agcauccuggaauaucuccguca

SEQ ID NO: 47599 - RNA, 15 nt, Homo sapiens
agcaucucugaacau

SEQ ID NO: 47600 - RNA, 15 nt, Homo sapiens
agcaugggaagugac

SEQ ID NO: 47601 - RNA, 17 nt, Homo sapiens
agcaugggccuagccca

SEQ ID NO: 47602 - RNA, 16 nt, Homo sapiens
agcauuccaacuaucu

SEQ ID NO: 47603 - RNA, 18 nt, Homo sapiens
agcauuguaaaugugcuu

SEQ ID NO: 47604 - RNA, 12 nt, Homo sapiens
agccaaaaacca

SEQ ID NO: 47605 - RNA, 18 nt, Homo sapiens
agccaaguuuauauacaa

SEQ ID NO: 47606 - RNA, 15 nt, Homo sapiens
agccaccaaacccgg

SEQ ID NO: 47607 - RNA, 16 nt, Homo sapiens
agccaccaaacccggc

SEQ ID NO: 47608 - RNA, 13 nt, Homo sapiens
agccacugugaua

SEQ ID NO: 47609 - RNA, 14 nt, Homo sapiens
agccacuucacuuu

SEQ ID NO: 47610 - RNA, 23 nt, Homo sapiens
agccagccuugcuccuggcuggg

SEQ ID NO: 47611 - RNA, 14 nt, Homo sapiens
agccaggcggcugg

SEQ ID NO: 47612 - RNA, 17 nt, Homo sapiens
agccagguaccuucuca

SEQ ID NO: 47613 - RNA, 18 nt, Homo sapiens
agccagguaccuucucac

SEQ ID NO: 47614 - RNA, 19 nt, Homo sapiens
agccaucggagcugcuaga

SEQ ID NO: 47615 - RNA, 23 nt, Homo sapiens
agccaugugauuacccucugggu

SEQ ID NO: 47616 - RNA, 24 nt, Homo sapiens
agccaugugauuacccucuggguc

SEQ ID NO: 47617 - RNA, 17 nt, Homo sapiens
agcccacuggcucccug

SEQ ID NO: 47618 - RNA, 15 nt, Homo sapiens
agcccauggcacucu

SEQ ID NO: 47619 - RNA, 16 nt, Homo sapiens
agcccauggcacucua

SEQ ID NO: 47620 - RNA, 12 nt, Homo sapiens
agccccaaaagg

SEQ ID NO: 47621 - RNA, 10 nt, Homo sapiens
agccccaggc

SEQ ID NO: 47622 - RNA, 11 nt, Homo sapiens
agccccaggcg

SEQ ID NO: 47623 - RNA, 12 nt, Homo sapiens
agccccaggcgg

SEQ ID NO: 47624 - RNA, 20 nt, Homo sapiens
agccccaggcggguccgggu

SEQ ID NO: 47625 - RNA, 22 nt, Homo sapiens
agccccaggcggguccgggucg

SEQ ID NO: 47626 - RNA, 12 nt, Homo sapiens
agccccgggagu

SEQ ID NO: 47627 - RNA, 17 nt, Homo sapiens
agccccgggaguggcgc

SEQ ID NO: 47628 - RNA, 18 nt, Homo sapiens
agccccgggaguggcgcg

SEQ ID NO: 47629 - RNA, 19 nt, Homo sapiens
agccccgggaguggcgcgc

SEQ ID NO: 47630 - RNA, 18 nt, Homo sapiens
agccccuugggcagguca

SEQ ID NO: 47631 - RNA, 19 nt, Homo sapiens
agccccuugggcaggucac

SEQ ID NO: 47632 - RNA, 17 nt, Homo sapiens
agcccggaaacuccaca

SEQ ID NO: 47633 - RNA, 14 nt, Homo sapiens
agcccucuucugac

SEQ ID NO: 47634 - RNA, 19 nt, Homo sapiens
agcccuuacguccuuccac

SEQ ID NO: 47635 - RNA, 15 nt, Homo sapiens
agccggagccccuug

SEQ ID NO: 47636 - RNA, 11 nt, Homo sapiens
agccggagccu

SEQ ID NO: 47637 - RNA, 12 nt, Homo sapiens
agccggagccuc

SEQ ID NO: 47638 - RNA, 15 nt, Homo sapiens
agccggagccuccag

SEQ ID NO: 47639 - RNA, 16 nt, Homo sapiens
agccggagccuccagc

SEQ ID NO: 47640 - RNA, 18 nt, Homo sapiens
agccggagccuccagcug

SEQ ID NO: 47641 - RNA, 23 nt, Homo sapiens
agccggagccuccagcugccccg

SEQ ID NO: 47642 - RNA, 18 nt, Homo sapiens
agccgggaaagaagagcc

SEQ ID NO: 47643 - RNA, 20 nt, Homo sapiens
agccgggaaagaagagccgg

SEQ ID NO: 47644 - RNA, 21 nt, Homo sapiens
agccgggcaugguggcgcgca

SEQ ID NO: 47645 - RNA, 16 nt, Homo sapiens
agccuaguugaucagc

SEQ ID NO: 47646 - RNA, 14 nt, Homo sapiens
agccucagcucuca

SEQ ID NO: 47647 - RNA, 13 nt, Homo sapiens
agccuccagcugc

SEQ ID NO: 47648 - RNA, 14 nt, Homo sapiens
agccuccagcugcc

SEQ ID NO: 47649 - RNA, 15 nt, Homo sapiens
agccuccagcugccc

SEQ ID NO: 47650 - RNA, 15 nt, Homo sapiens
agccucuauugccau

SEQ ID NO: 47651 - RNA, 16 nt, Homo sapiens
agccucuauugccaug

SEQ ID NO: 47652 - RNA, 17 nt, Homo sapiens
agccucuauugccauga

SEQ ID NO: 47653 - RNA, 19 nt, Homo sapiens
agccucuauugccaugaga

SEQ ID NO: 47654 - RNA, 11 nt, Homo sapiens
agccugaccac

SEQ ID NO: 47655 - RNA, 22 nt, Homo sapiens
agccugccucaaucaguauuca

SEQ ID NO: 47656 - RNA, 18 nt, Homo sapiens
agccuugcuccuggcugg

SEQ ID NO: 47657 - RNA, 23 nt, Homo sapiens
agccuuggggcugaugcaguugu

SEQ ID NO: 47658 - RNA, 24 nt, Homo sapiens
agccuuggggcugaugcaguuguu

SEQ ID NO: 47659 - RNA, 22 nt, Homo sapiens
agccuuuguugcuaucaaucca

SEQ ID NO: 47660 - RNA, 12 nt, Homo sapiens
agcgacagugag

SEQ ID NO: 47661 - RNA, 14 nt, Homo sapiens
agcgagccccaggc

SEQ ID NO: 47662 - RNA, 16 nt, Homo sapiens
agcgagccccaggcgg

SEQ ID NO: 47663 - RNA, 17 nt, Homo sapiens
agcgagccccaggcggg

SEQ ID NO: 47664 - RNA, 21 nt, Homo sapiens
agcgagccccaggcggguccg

SEQ ID NO: 47665 - RNA, 15 nt, Homo sapiens
agcgagggacaccga

SEQ ID NO: 47666 - RNA, 14 nt, Homo sapiens
agcgaguacuuccc

SEQ ID NO: 47667 - RNA, 13 nt, Homo sapiens
agcgcagccaugu

SEQ ID NO: 47668 - RNA, 12 nt, Homo sapiens
agcgcgcgcgcc

SEQ ID NO: 47669 - RNA, 13 nt, Homo sapiens
agcgcgcgcgccc

SEQ ID NO: 47670 - RNA, 14 nt, Homo sapiens
agcgcgcgcgcccu

SEQ ID NO: 47671 - RNA, 17 nt, Homo sapiens
agcggaccuucccagcu

SEQ ID NO: 47672 - RNA, 18 nt, Homo sapiens
agcggaccuucccagcua

SEQ ID NO: 47673 - RNA, 15 nt, Homo sapiens
agcuaagauauaauu

SEQ ID NO: 47674 - RNA, 20 nt, Homo sapiens
agcuaaguugcaccaacuuu

SEQ ID NO: 47675 - RNA, 20 nt, Homo sapiens
agcuacuugggaggcugaga

SEQ ID NO: 47676 - RNA, 19 nt, Homo sapiens
agcuagaaaacaggcaaau

SEQ ID NO: 47677 - RNA, 17 nt, Homo sapiens
agcuagaauucacucca

SEQ ID NO: 47678 - RNA, 18 nt, Homo sapiens
agcuagaauucacuccac

SEQ ID NO: 47679 - RNA, 18 nt, Homo sapiens
agcuagaauuugauaugu

SEQ ID NO: 47680 - RNA, 22 nt, Homo sapiens
agcuaggggggucagccagccc

SEQ ID NO: 47681 - RNA, 11 nt, Homo sapiens
agcucaggcug

SEQ ID NO: 47682 - RNA, 15 nt, Homo sapiens
agcucaggcuggcac

SEQ ID NO: 47683 - RNA, 16 nt, Homo sapiens
agcucaggcuggcacc

SEQ ID NO: 47684 - RNA, 19 nt, Homo sapiens
agcucaggcuggcaccgcu

SEQ ID NO: 47685 - RNA, 23 nt, Homo sapiens
agcuccaccuuacuucuucucau

SEQ ID NO: 47686 - RNA, 13 nt, Homo sapiens
agcucguggaaca

SEQ ID NO: 47687 - RNA, 20 nt, Homo sapiens
agcucuaucccaaccucucc

SEQ ID NO: 47688 - RNA, 15 nt, Homo sapiens
agcucucaguugcag

SEQ ID NO: 47689 - RNA, 17 nt, Homo sapiens
agcucucaguugcagcc

SEQ ID NO: 47690 - RNA, 19 nt, Homo sapiens
agcucucaguugcagcccu

SEQ ID NO: 47691 - RNA, 22 nt, Homo sapiens
agcucucugaccuccuccuuca

SEQ ID NO: 47692 - RNA, 22 nt, Homo sapiens
agcugaauacauucugcuuuca

SEQ ID NO: 47693 - RNA, 19 nt, Homo sapiens
agcugauaucaugccccug

SEQ ID NO: 47694 - RNA, 19 nt, Homo sapiens
agcugccccggggaggggc

SEQ ID NO: 47695 - RNA, 23 nt, Homo sapiens
agcugccuccccagcucuauccc

SEQ ID NO: 47696 - RNA, 14 nt, Homo sapiens
agcugccucucuca

SEQ ID NO: 47697 - RNA, 20 nt, Homo sapiens
agcugccucucucauccacu

SEQ ID NO: 47698 - RNA, 21 nt, Homo sapiens
agcugcugaaacaacaaauag

SEQ ID NO: 47699 - RNA, 16 nt, Homo sapiens
agcuggaaaaguaugu

SEQ ID NO: 47700 - RNA, 17 nt, Homo sapiens
agcuggaaaaguauguu

SEQ ID NO: 47701 - RNA, 12 nt, Homo sapiens
agcuguggccag

SEQ ID NO: 47702 - RNA, 13 nt, Homo sapiens
agcuguggccagc

SEQ ID NO: 47703 - RNA, 19 nt, Homo sapiens
agcuguggccagcuuguua

SEQ ID NO: 47704 - RNA, 13 nt, Homo sapiens
agcuguugagcug

SEQ ID NO: 47705 - RNA, 20 nt, Homo sapiens
agcuguuuaugcauagauaa

SEQ ID NO: 47706 - RNA, 14 nt, Homo sapiens
agcuguuuccauag

SEQ ID NO: 47707 - RNA, 18 nt, Homo sapiens
agcuguuuucccugaccu

SEQ ID NO: 47708 - RNA, 16 nt, Homo sapiens
agcuuauuaaaacuca

SEQ ID NO: 47709 - RNA, 17 nt, Homo sapiens
agcuuauugucuaguga

SEQ ID NO: 47710 - RNA, 19 nt, Homo sapiens
agcuugaaacugagaugug

SEQ ID NO: 47711 - RNA, 22 nt, Homo sapiens
agcuugaaauagugucugauga

SEQ ID NO: 47712 - RNA, 15 nt, Homo sapiens
agcuuucucuaguuc

SEQ ID NO: 47713 - RNA, 22 nt, Homo sapiens
agcuuuucaaaauuggacuuaa

SEQ ID NO: 47714 - RNA, 20 nt, Homo sapiens
aggaaauauucuguaaucuu

SEQ ID NO: 47715 - RNA, 14 nt, Homo sapiens
aggaaauauuuauu

SEQ ID NO: 47716 - RNA, 10 nt, Homo sapiens
aggaacagaa

SEQ ID NO: 47717 - RNA, 15 nt, Homo sapiens
aggaauuguuuuuau

SEQ ID NO: 47718 - RNA, 11 nt, Homo sapiens
aggaccauccc

SEQ ID NO: 47719 - RNA, 14 nt, Homo sapiens
aggaccaucccggc

SEQ ID NO: 47720 - RNA, 15 nt, Homo sapiens
aggaccaucccggcc

SEQ ID NO: 47721 - RNA, 18 nt, Homo sapiens
aggaccaucccggccggc

SEQ ID NO: 47722 - RNA, 20 nt, Homo sapiens
aggaccaucccggccggcgc

SEQ ID NO: 47723 - RNA, 22 nt, Homo sapiens
aggaccaucccggccggcgcgc

SEQ ID NO: 47724 - RNA, 12 nt, Homo sapiens
aggacuguagaa

SEQ ID NO: 47725 - RNA, 13 nt, Homo sapiens
aggacuguagaaa

SEQ ID NO: 47726 - RNA, 22 nt, Homo sapiens
aggacuugggcgggacacaggc

SEQ ID NO: 47727 - RNA, 20 nt, Homo sapiens
aggagauggaaguugcagug

SEQ ID NO: 47728 - RNA, 16 nt, Homo sapiens
aggagauuucaugccu

SEQ ID NO: 47729 - RNA, 12 nt, Homo sapiens
aggagccugcaa

SEQ ID NO: 47730 - RNA, 13 nt, Homo sapiens
aggagccugcaac

SEQ ID NO: 47731 - RNA, 14 nt, Homo sapiens
aggagccugcaaca

SEQ ID NO: 47732 - RNA, 16 nt, Homo sapiens
aggagcucccaggagg

SEQ ID NO: 47733 - RNA, 21 nt, Homo sapiens
aggaggggaaggcaacauaca

SEQ ID NO: 47734 - RNA, 23 nt, Homo sapiens
aggaguuccuaaccagccugguc

SEQ ID NO: 47735 - RNA, 15 nt, Homo sapiens
aggauaagagggauu

SEQ ID NO: 47736 - RNA, 17 nt, Homo sapiens
aggauagagugggacag

SEQ ID NO: 47737 - RNA, 18 nt, Homo sapiens
aggaucugcuuggucuug

SEQ ID NO: 47738 - RNA, 10 nt, Homo sapiens
aggaugcaca

SEQ ID NO: 47739 - RNA, 14 nt, Homo sapiens
aggaugcccacggc

SEQ ID NO: 47740 - RNA, 17 nt, Homo sapiens
aggaugcuuguacauaa

SEQ ID NO: 47741 - RNA, 14 nt, Homo sapiens
aggauggcaggagg

SEQ ID NO: 47742 - RNA, 11 nt, Homo sapiens
aggaugguucc

SEQ ID NO: 47743 - RNA, 13 nt, Homo sapiens
aggcaagagaauu

SEQ ID NO: 47744 - RNA, 19 nt, Homo sapiens
aggcaaggcuaugugauua

SEQ ID NO: 47745 - RNA, 21 nt, Homo sapiens
aggcagagguugcagugagcc

SEQ ID NO: 47746 - RNA, 22 nt, Homo sapiens
aggcagcaggauagagugggac

SEQ ID NO: 47747 - RNA, 16 nt, Homo sapiens
aggcaggggaauguau

SEQ ID NO: 47748 - RNA, 20 nt, Homo sapiens
aggcauacugccuuguuuaa

SEQ ID NO: 47749 - RNA, 19 nt, Homo sapiens
aggcauauuuaacaaaauu

SEQ ID NO: 47750 - RNA, 12 nt, Homo sapiens
aggcaucgccau

SEQ ID NO: 47751 - RNA, 13 nt, Homo sapiens
aggcaucgccauu

SEQ ID NO: 47752 - RNA, 11 nt, Homo sapiens
aggcauguaau

SEQ ID NO: 47753 - RNA, 15 nt, Homo sapiens
aggcauucucugaag

SEQ ID NO: 47754 - RNA, 16 nt, Homo sapiens
aggcauuugcagcugu

SEQ ID NO: 47755 - RNA, 20 nt, Homo sapiens
aggcauuugcagcugugcca

SEQ ID NO: 47756 - RNA, 14 nt, Homo sapiens
aggccaccuggauu

SEQ ID NO: 47757 - RNA, 15 nt, Homo sapiens
aggcccccgggccga

SEQ ID NO: 47758 - RNA, 17 nt, Homo sapiens
aggcccccgggccgacg

SEQ ID NO: 47759 - RNA, 18 nt, Homo sapiens
aggcccccgggccgacgg

SEQ ID NO: 47760 - RNA, 20 nt, Homo sapiens
aggcccccgggccgacggag

SEQ ID NO: 47761 - RNA, 20 nt, Homo sapiens
aggcccugcccuuacaggaa

SEQ ID NO: 47762 - RNA, 20 nt, Homo sapiens
aggccgggcgcgguggcuca

SEQ ID NO: 47763 - RNA, 17 nt, Homo sapiens
aggccugucccugcaga

SEQ ID NO: 47764 - RNA, 22 nt, Homo sapiens
aggcggguccgggucgcaggac

SEQ ID NO: 47765 - RNA, 15 nt, Homo sapiens
aggcuccaaacugga

SEQ ID NO: 47766 - RNA, 18 nt, Homo sapiens
aggcuccugagacacaug

SEQ ID NO: 47767 - RNA, 14 nt, Homo sapiens
aggcugaggcgggu

SEQ ID NO: 47768 - RNA, 10 nt, Homo sapiens
aggcugcaaa

SEQ ID NO: 47769 - RNA, 20 nt, Homo sapiens
aggcuggagugcaguggcgc

SEQ ID NO: 47770 - RNA, 22 nt, Homo sapiens
aggcuggagugcaguggcgcaa

SEQ ID NO: 47771 - RNA, 15 nt, Homo sapiens
aggcuggcaccgcug

SEQ ID NO: 47772 - RNA, 17 nt, Homo sapiens
aggcuggucucgaacug

SEQ ID NO: 47773 - RNA, 17 nt, Homo sapiens
aggcuguggauuuaaug

SEQ ID NO: 47774 - RNA, 20 nt, Homo sapiens
aggcuuagacccucaugcug

SEQ ID NO: 47775 - RNA, 21 nt, Homo sapiens
aggcuuagacccucaugcugc

SEQ ID NO: 47776 - RNA, 16 nt, Homo sapiens
aggcuuuaucucaggg

SEQ ID NO: 47777 - RNA, 21 nt, Homo sapiens
agggaccucuccaugauccca

SEQ ID NO: 47778 - RNA, 13 nt, Homo sapiens
agggaccugcugu

SEQ ID NO: 47779 - RNA, 22 nt, Homo sapiens
agggacuucugucuucacaaca

SEQ ID NO: 47780 - RNA, 15 nt, Homo sapiens
agggacuugaaccca

SEQ ID NO: 47781 - RNA, 17 nt, Homo sapiens
agggauggcaagaugug

SEQ ID NO: 47782 - RNA, 18 nt, Homo sapiens
agggauggcaagaugugg

SEQ ID NO: 47783 - RNA, 19 nt, Homo sapiens
agggauggcaagauguggg

SEQ ID NO: 47784 - RNA, 20 nt, Homo sapiens
agggccuggcugggaguggc

SEQ ID NO: 47785 - RNA, 9 nt, Homo sapiens
agggcgcgg

SEQ ID NO: 47786 - RNA, 12 nt, Homo sapiens
agggcgcggggc

SEQ ID NO: 47787 - RNA, 14 nt, Homo sapiens
agggcgcggggcgg

SEQ ID NO: 47788 - RNA, 18 nt, Homo sapiens
agggcgcggggcggggag

SEQ ID NO: 47789 - RNA, 14 nt, Homo sapiens
agggcuacgcgcgc

SEQ ID NO: 47790 - RNA, 10 nt, Homo sapiens
agggcuugag

SEQ ID NO: 47791 - RNA, 19 nt, Homo sapiens
agggcuugaggacuugggc

SEQ ID NO: 47792 - RNA, 14 nt, Homo sapiens
aggggcaguggugg

SEQ ID NO: 47793 - RNA, 13 nt, Homo sapiens
aggggcgcucgcu

SEQ ID NO: 47794 - RNA, 14 nt, Homo sapiens
aggggcgcucgcuu

SEQ ID NO: 47795 - RNA, 16 nt, Homo sapiens
aggggcgcucgcuucc

SEQ ID NO: 47796 - RNA, 12 nt, Homo sapiens
aggggcggcggc

SEQ ID NO: 47797 - RNA, 15 nt, Homo sapiens
aggggcggcggcccu

SEQ ID NO: 47798 - RNA, 21 nt, Homo sapiens
aggggcggcggcccugugcgg

SEQ ID NO: 47799 - RNA, 17 nt, Homo sapiens
aggggcuuaauuauuga

SEQ ID NO: 47800 - RNA, 14 nt, Homo sapiens
agggggcgcgugca

SEQ ID NO: 47801 - RNA, 16 nt, Homo sapiens
aggggggucagccagc

SEQ ID NO: 47802 - RNA, 17 nt, Homo sapiens
aggguacacugccuucu

SEQ ID NO: 47803 - RNA, 18 nt, Homo sapiens
aggguacacugccuucuc

SEQ ID NO: 47804 - RNA, 22 nt, Homo sapiens
agggucucccucuguugccaag

SEQ ID NO: 47805 - RNA, 15 nt, Homo sapiens
agggugaacugcagc

SEQ ID NO: 47806 - RNA, 17 nt, Homo sapiens
agggugcacacaggaug

SEQ ID NO: 47807 - RNA, 19 nt, Homo sapiens
agguaccagccuuggauac

SEQ ID NO: 47808 - RNA, 23 nt, Homo sapiens
agguaccuucucaccugugagac

SEQ ID NO: 47809 - RNA, 14 nt, Homo sapiens
agguagccaucaug

SEQ ID NO: 47810 - RNA, 19 nt, Homo sapiens
agguauuuauugagcaccu

SEQ ID NO: 47811 - RNA, 19 nt, Homo sapiens
agguauuuuaaucaccaag

SEQ ID NO: 47812 - RNA, 19 nt, Homo sapiens
aggucacagaggaucugcu

SEQ ID NO: 47813 - RNA, 20 nt, Homo sapiens
aggucacagaggaucugcuu

SEQ ID NO: 47814 - RNA, 10 nt, Homo sapiens
aggucauuuu

SEQ ID NO: 47815 - RNA, 9 nt, Homo sapiens
aggugacca

SEQ ID NO: 47816 - RNA, 16 nt, Homo sapiens
aggugacccugaugaa

SEQ ID NO: 47817 - RNA, 18 nt, Homo sapiens
aggugcuacaaaaacaca

SEQ ID NO: 47818 - RNA, 19 nt, Homo sapiens
aggugcuacaaaaacacag

SEQ ID NO: 47819 - RNA, 20 nt, Homo sapiens
aggugcuacaaaaacacagc

SEQ ID NO: 47820 - RNA, 21 nt, Homo sapiens
aggugcuacaaaaacacagca

SEQ ID NO: 47821 - RNA, 16 nt, Homo sapiens
aggugucuugcuggcu

SEQ ID NO: 47822 - RNA, 17 nt, Homo sapiens
aggugucuugcuggcuu

SEQ ID NO: 47823 - RNA, 13 nt, Homo sapiens
agguuaugauuga

SEQ ID NO: 47824 - RNA, 21 nt, Homo sapiens
agguuguuggauaaaucagug

SEQ ID NO: 47825 - RNA, 14 nt, Homo sapiens
agguuuggacaaaa

SEQ ID NO: 47826 - RNA, 18 nt, Homo sapiens
agguuuuuaagccuuaaa

SEQ ID NO: 47827 - RNA, 16 nt, Homo sapiens
aguaaaggcaaacuua

SEQ ID NO: 47828 - RNA, 17 nt, Homo sapiens
aguaacggaacaguauc

SEQ ID NO: 47829 - RNA, 17 nt, Homo sapiens
aguaauaugcacacauu

SEQ ID NO: 47830 - RNA, 19 nt, Homo sapiens
aguaauaugcacacauuuu

SEQ ID NO: 47831 - RNA, 12 nt, Homo sapiens
aguacagacuuu

SEQ ID NO: 47832 - RNA, 13 nt, Homo sapiens
aguacagacuuuu

SEQ ID NO: 47833 - RNA, 14 nt, Homo sapiens
aguaccucugcuau

SEQ ID NO: 47834 - RNA, 17 nt, Homo sapiens
aguacguugugcauuug

SEQ ID NO: 47835 - RNA, 18 nt, Homo sapiens
aguacguugugcauuugg

SEQ ID NO: 47836 - RNA, 14 nt, Homo sapiens
aguagauuaagaga

SEQ ID NO: 47837 - RNA, 12 nt, Homo sapiens
aguagcagcagc

SEQ ID NO: 47838 - RNA, 14 nt, Homo sapiens
aguaguuagcuuuc

SEQ ID NO: 47839 - RNA, 22 nt, Homo sapiens
aguauaaauaaaaugagcaaaa

SEQ ID NO: 47840 - RNA, 20 nt, Homo sapiens
aguaucagcuacaauuguaa

SEQ ID NO: 47841 - RNA, 18 nt, Homo sapiens
aguaucccuacuguaauu

SEQ ID NO: 47842 - RNA, 18 nt, Homo sapiens
aguaucugacaucucugc

SEQ ID NO: 47843 - RNA, 16 nt, Homo sapiens
aguaugaaaaugucau

SEQ ID NO: 47844 - RNA, 18 nt, Homo sapiens
aguaugaaaaugucauug

SEQ ID NO: 47845 - RNA, 16 nt, Homo sapiens
aguaugaggcauuugu

SEQ ID NO: 47846 - RNA, 22 nt, Homo sapiens
aguaugcacuaaucaauacuuu

SEQ ID NO: 47847 - RNA, 13 nt, Homo sapiens
aguaugugcauuu

SEQ ID NO: 47848 - RNA, 18 nt, Homo sapiens
agucaaggcuuagacccu

SEQ ID NO: 47849 - RNA, 18 nt, Homo sapiens
agucacuaguuguaauuu

SEQ ID NO: 47850 - RNA, 14 nt, Homo sapiens
agucagaagaccug

SEQ ID NO: 47851 - RNA, 17 nt, Homo sapiens
agucagucauucagaua

SEQ ID NO: 47852 - RNA, 16 nt, Homo sapiens
agucauucagauauga

SEQ ID NO: 47853 - RNA, 17 nt, Homo sapiens
agucauucagauaugau

SEQ ID NO: 47854 - RNA, 16 nt, Homo sapiens
agucauucugccugcc

SEQ ID NO: 47855 - RNA, 17 nt, Homo sapiens
agucauucugccugccc

SEQ ID NO: 47856 - RNA, 20 nt, Homo sapiens
agucccagaucaagccugcc

SEQ ID NO: 47857 - RNA, 22 nt, Homo sapiens
agucucuaucauuaaaguucua

SEQ ID NO: 47858 - RNA, 23 nt, Homo sapiens
agucucuaucauuaaaguucuag

SEQ ID NO: 47859 - RNA, 12 nt, Homo sapiens
agucuguuuuau

SEQ ID NO: 47860 - RNA, 13 nt, Homo sapiens
agucuguuuuaug

SEQ ID NO: 47861 - RNA, 20 nt, Homo sapiens
agucuucagcagagaaguuu

SEQ ID NO: 47862 - RNA, 16 nt, Homo sapiens
agucuuguauuaaguu

SEQ ID NO: 47863 - RNA, 15 nt, Homo sapiens
agugaaaaacaucca

SEQ ID NO: 47864 - RNA, 20 nt, Homo sapiens
agugaaaaucuacacuccag

SEQ ID NO: 47865 - RNA, 20 nt, Homo sapiens
agugaacaaauuuacagaga

SEQ ID NO: 47866 - RNA, 19 nt, Homo sapiens
agugacaagcucacagacc

SEQ ID NO: 47867 - RNA, 15 nt, Homo sapiens
agugacauguuuaca

SEQ ID NO: 47868 - RNA, 22 nt, Homo sapiens
agugacauguuuacaaaccuca

SEQ ID NO: 47869 - RNA, 23 nt, Homo sapiens
agugacauguuuacaaaccucaa

SEQ ID NO: 47870 - RNA, 13 nt, Homo sapiens
agugauccgccca

SEQ ID NO: 47871 - RNA, 13 nt, Homo sapiens
agugcaguggcgc

SEQ ID NO: 47872 - RNA, 14 nt, Homo sapiens
agugcaguggcgca

SEQ ID NO: 47873 - RNA, 13 nt, Homo sapiens
agugcuuggccca

SEQ ID NO: 47874 - RNA, 15 nt, Homo sapiens
agugcuuggcccagg

SEQ ID NO: 47875 - RNA, 19 nt, Homo sapiens
agugcuuggcccaggaguu

SEQ ID NO: 47876 - RNA, 14 nt, Homo sapiens
aguggcauguauga

SEQ ID NO: 47877 - RNA, 16 nt, Homo sapiens
aguggcgcgcgccacc

SEQ ID NO: 47878 - RNA, 19 nt, Homo sapiens
aguggcgcgcgccaccacg

SEQ ID NO: 47879 - RNA, 21 nt, Homo sapiens
aguggcgcgcgccaccacgcc

SEQ ID NO: 47880 - RNA, 22 nt, Homo sapiens
aguggcgcgcgccaccacgccc

SEQ ID NO: 47881 - RNA, 14 nt, Homo sapiens
aguggguuucacaa

SEQ ID NO: 47882 - RNA, 22 nt, Homo sapiens
agugguuauuuagggaacugcu

SEQ ID NO: 47883 - RNA, 15 nt, Homo sapiens
aguguaaguucacaa

SEQ ID NO: 47884 - RNA, 16 nt, Homo sapiens
agugucaaugcagccc

SEQ ID NO: 47885 - RNA, 23 nt, Homo sapiens
aguguccucaucuguaaaaugga

SEQ ID NO: 47886 - RNA, 16 nt, Homo sapiens
agugucugaugaaugu

SEQ ID NO: 47887 - RNA, 15 nt, Homo sapiens
agugugacucauuaa

SEQ ID NO: 47888 - RNA, 20 nt, Homo sapiens
aguguuggaaaaugugcaau

SEQ ID NO: 47889 - RNA, 21 nt, Homo sapiens
aguguuggaaaaugugcaaua

SEQ ID NO: 47890 - RNA, 12 nt, Homo sapiens
aguguuggagaa

SEQ ID NO: 47891 - RNA, 12 nt, Homo sapiens
aguguuuagcau

SEQ ID NO: 47892 - RNA, 16 nt, Homo sapiens
aguuaagcaacaucua

SEQ ID NO: 47893 - RNA, 17 nt, Homo sapiens
aguuacugccgguuuga

SEQ ID NO: 47894 - RNA, 15 nt, Homo sapiens
aguuauuuuuaaacu

SEQ ID NO: 47895 - RNA, 17 nt, Homo sapiens
aguuauuuuuaauuugg

SEQ ID NO: 47896 - RNA, 16 nt, Homo sapiens
aguucaaguucaccag

SEQ ID NO: 47897 - RNA, 21 nt, Homo sapiens
aguucaauccugauucauauu

SEQ ID NO: 47898 - RNA, 17 nt, Homo sapiens
aguucaccagacucuau

SEQ ID NO: 47899 - RNA, 19 nt, Homo sapiens
aguuccuaaccagccuggu

SEQ ID NO: 47900 - RNA, 18 nt, Homo sapiens
aguuccugagaccagcca

SEQ ID NO: 47901 - RNA, 15 nt, Homo sapiens
aguuccuucugcucc

SEQ ID NO: 47902 - RNA, 22 nt, Homo sapiens
aguucuacuccauuaaauauaa

SEQ ID NO: 47903 - RNA, 15 nt, Homo sapiens
aguucuagugaccga

SEQ ID NO: 47904 - RNA, 20 nt, Homo sapiens
aguucuaugagggcuaauau

SEQ ID NO: 47905 - RNA, 15 nt, Homo sapiens
aguucugaagaagau

SEQ ID NO: 47906 - RNA, 24 nt, Homo sapiens
aguucugaagaagaugguaccacc

SEQ ID NO: 47907 - RNA, 15 nt, Homo sapiens
aguucugucuggacu

SEQ ID NO: 47908 - RNA, 20 nt, Homo sapiens
aguucugucuggacuuucca

SEQ ID NO: 47909 - RNA, 17 nt, Homo sapiens
aguucuucaaagauagg

SEQ ID NO: 47910 - RNA, 15 nt, Homo sapiens
aguugaauuuuacau

SEQ ID NO: 47911 - RNA, 16 nt, Homo sapiens
aguugauaugccuuuu

SEQ ID NO: 47912 - RNA, 14 nt, Homo sapiens
aguugauuuuacaa

SEQ ID NO: 47913 - RNA, 13 nt, Homo sapiens
aguugcuguaugu

SEQ ID NO: 47914 - RNA, 23 nt, Homo sapiens
aguuguaccgcaaugugacuuaa

SEQ ID NO: 47915 - RNA, 13 nt, Homo sapiens
aguuuauauagaa

SEQ ID NO: 47916 - RNA, 14 nt, Homo sapiens
aguuuauauagaaa

SEQ ID NO: 47917 - RNA, 22 nt, Homo sapiens
aguuuauauagaaauguauucu

SEQ ID NO: 47918 - RNA, 22 nt, Homo sapiens
aguuuggccagaagucaaggcu

SEQ ID NO: 47919 - RNA, 21 nt, Homo sapiens
aguuuuauaugcuucuguuuu

SEQ ID NO: 47920 - RNA, 23 nt, Homo sapiens
aguuuuccuucucaucugugauu

SEQ ID NO: 47921 - RNA, 19 nt, Homo sapiens
aguuuuggaaacguauuca

SEQ ID NO: 47922 - RNA, 14 nt, Homo sapiens
auaaaacuuuucca

SEQ ID NO: 47923 - RNA, 19 nt, Homo sapiens
auaaaacuuuuccaaugac

SEQ ID NO: 47924 - RNA, 13 nt, Homo sapiens
auaaaagcacuua

SEQ ID NO: 47925 - RNA, 15 nt, Homo sapiens
auaaaauauuuaaaa

SEQ ID NO: 47926 - RNA, 18 nt, Homo sapiens
auaaaauccauacauuug

SEQ ID NO: 47927 - RNA, 19 nt, Homo sapiens
auaaaauccauacauuugu

SEQ ID NO: 47928 - RNA, 18 nt, Homo sapiens
auaaaauucauuccauuu

SEQ ID NO: 47929 - RNA, 17 nt, Homo sapiens
auaaaauuuuuauguaa

SEQ ID NO: 47930 - RNA, 18 nt, Homo sapiens
auaaacaagaccacguuu

SEQ ID NO: 47931 - RNA, 19 nt, Homo sapiens
auaaacgucuuaaauauuc

SEQ ID NO: 47932 - RNA, 16 nt, Homo sapiens
auaaacucagaaauuu

SEQ ID NO: 47933 - RNA, 20 nt, Homo sapiens
auaaagcacuguuuggauau

SEQ ID NO: 47934 - RNA, 14 nt, Homo sapiens
auaaagcagcguuu

SEQ ID NO: 47935 - RNA, 18 nt, Homo sapiens
auaaauaucuagaaauga

SEQ ID NO: 47936 - RNA, 20 nt, Homo sapiens
auaaauucccuggccuuuca

SEQ ID NO: 47937 - RNA, 9 nt, Homo sapiens
auaaauuug

SEQ ID NO: 47938 - RNA, 23 nt, Homo sapiens
auaaauuuucuucuugguucuga

SEQ ID NO: 47939 - RNA, 22 nt, Homo sapiens
auaaccaugcccaagaaugaga

SEQ ID NO: 47940 - RNA, 22 nt, Homo sapiens
auaacuaggcguggacuuacua

SEQ ID NO: 47941 - RNA, 12 nt, Homo sapiens
auaacuguuauu

SEQ ID NO: 47942 - RNA, 21 nt, Homo sapiens
auaacuuuuuuuuaaguuaca

SEQ ID NO: 47943 - RNA, 17 nt, Homo sapiens
auaagcaaagacuauga

SEQ ID NO: 47944 - RNA, 22 nt, Homo sapiens
auaagcuuguauuccuuuuucu

SEQ ID NO: 47945 - RNA, 22 nt, Homo sapiens
auaagugaagugauacuaucca

SEQ ID NO: 47946 - RNA, 16 nt, Homo sapiens
auaauacuagucuuau

SEQ ID NO: 47947 - RNA, 16 nt, Homo sapiens
auaauaugagaaucag

SEQ ID NO: 47948 - RNA, 22 nt, Homo sapiens
auaauuccuauauccugugacu

SEQ ID NO: 47949 - RNA, 16 nt, Homo sapiens
auaauuuuagacauuc

SEQ ID NO: 47950 - RNA, 22 nt, Homo sapiens
auaauuuugugaagcaaaauuu

SEQ ID NO: 47951 - RNA, 23 nt, Homo sapiens
auaauuuugugaagcaaaauuuu

SEQ ID NO: 47952 - RNA, 22 nt, Homo sapiens
auaauuuuuauauuugaaauau

SEQ ID NO: 47953 - RNA, 12 nt, Homo sapiens
auacaaucauca

SEQ ID NO: 47954 - RNA, 16 nt, Homo sapiens
auacaaucaucaaccc

SEQ ID NO: 47955 - RNA, 17 nt, Homo sapiens
auacaaucaucaacccc

SEQ ID NO: 47956 - RNA, 19 nt, Homo sapiens
auacaauuauuuuuacagu

SEQ ID NO: 47957 - RNA, 22 nt, Homo sapiens
auacaauuauuuuuacaguucu

SEQ ID NO: 47958 - RNA, 12 nt, Homo sapiens
auacacacucaa

SEQ ID NO: 47959 - RNA, 18 nt, Homo sapiens
auacaccagagauaauau

SEQ ID NO: 47960 - RNA, 12 nt, Homo sapiens
auacauaaacaa

SEQ ID NO: 47961 - RNA, 13 nt, Homo sapiens
auacauaaacaag

SEQ ID NO: 47962 - RNA, 17 nt, Homo sapiens
auacauaaacaagacca

SEQ ID NO: 47963 - RNA, 19 nt, Homo sapiens
auacauuauuggacuucca

SEQ ID NO: 47964 - RNA, 20 nt, Homo sapiens
auacauuauuggacuuccau

SEQ ID NO: 47965 - RNA, 16 nt, Homo sapiens
auacauucugcuuuca

SEQ ID NO: 47966 - RNA, 15 nt, Homo sapiens
auaccacaggaacca

SEQ ID NO: 47967 - RNA, 15 nt, Homo sapiens
auacguacacauuuu

SEQ ID NO: 47968 - RNA, 20 nt, Homo sapiens
auacgugggcauucaaaugu

SEQ ID NO: 47969 - RNA, 13 nt, Homo sapiens
auacuaauaaaau

SEQ ID NO: 47970 - RNA, 12 nt, Homo sapiens
auacuacaguuu

SEQ ID NO: 47971 - RNA, 13 nt, Homo sapiens
auacuacaguuug

SEQ ID NO: 47972 - RNA, 14 nt, Homo sapiens
auacuacaguuugu

SEQ ID NO: 47973 - RNA, 15 nt, Homo sapiens
auacuauccaguuac

SEQ ID NO: 47974 - RNA, 14 nt, Homo sapiens
auacuauuuaauua

SEQ ID NO: 47975 - RNA, 21 nt, Homo sapiens
auacuauuuaauuauuucacu

SEQ ID NO: 47976 - RNA, 23 nt, Homo sapiens
auacuauuuaauuauuucacuuu

SEQ ID NO: 47977 - RNA, 24 nt, Homo sapiens
auacuauuuaauuauuucacuuua

SEQ ID NO: 47978 - RNA, 18 nt, Homo sapiens
auacugaaauaaacgucu

SEQ ID NO: 47979 - RNA, 23 nt, Homo sapiens
auacugccuuguuuaauguuaau

SEQ ID NO: 47980 - RNA, 16 nt, Homo sapiens
auacuguauuuuuacc

SEQ ID NO: 47981 - RNA, 18 nt, Homo sapiens
auacuguuugagguuuuu

SEQ ID NO: 47982 - RNA, 17 nt, Homo sapiens
auacuucaauacuucau

SEQ ID NO: 47983 - RNA, 21 nt, Homo sapiens
auacuucuuaggguuaugauu

SEQ ID NO: 47984 - RNA, 17 nt, Homo sapiens
auagaagguuugcagau

SEQ ID NO: 47985 - RNA, 17 nt, Homo sapiens
auagaauuaacacauga

SEQ ID NO: 47986 - RNA, 13 nt, Homo sapiens
auagacaauuuau

SEQ ID NO: 47987 - RNA, 13 nt, Homo sapiens
auagacucuagga

SEQ ID NO: 47988 - RNA, 12 nt, Homo sapiens
auagcaagugaa

SEQ ID NO: 47989 - RNA, 17 nt, Homo sapiens
auagcagcuuauucaca

SEQ ID NO: 47990 - RNA, 14 nt, Homo sapiens
auagcaucucagga

SEQ ID NO: 47991 - RNA, 20 nt, Homo sapiens
auagccagguaccuucucac

SEQ ID NO: 47992 - RNA, 21 nt, Homo sapiens
auagccagguaccuucucacc

SEQ ID NO: 47993 - RNA, 21 nt, Homo sapiens
auagcuaagauauaauuuaaa

SEQ ID NO: 47994 - RNA, 23 nt, Homo sapiens
auaggaaauauuuuaauguuucu

SEQ ID NO: 47995 - RNA, 20 nt, Homo sapiens
auaggugcuacaaaaacaca

SEQ ID NO: 47996 - RNA, 21 nt, Homo sapiens
auagugucugaugaauguuaa

SEQ ID NO: 47997 - RNA, 16 nt, Homo sapiens
auaguguuggaaaaug

SEQ ID NO: 47998 - RNA, 23 nt, Homo sapiens
auaguguuggaaaaugugcaaua

SEQ ID NO: 47999 - RNA, 15 nt, Homo sapiens
auaguuguaccgcaa

SEQ ID NO: 48000 - RNA, 19 nt, Homo sapiens
auauaaaaauaaagcacuu

SEQ ID NO: 48001 - RNA, 13 nt, Homo sapiens
auauaaauuuauc

SEQ ID NO: 48002 - RNA, 20 nt, Homo sapiens
auauaauaugcacacagugc

SEQ ID NO: 48003 - RNA, 14 nt, Homo sapiens
auauauauuuuuuu

SEQ ID NO: 48004 - RNA, 20 nt, Homo sapiens
auauauguguuuuucacauu

SEQ ID NO: 48005 - RNA, 17 nt, Homo sapiens
auauauuuccuuauuca

SEQ ID NO: 48006 - RNA, 13 nt, Homo sapiens
auauauuuuuaga

SEQ ID NO: 48007 - RNA, 13 nt, Homo sapiens
auauauuuuuuuu

SEQ ID NO: 48008 - RNA, 14 nt, Homo sapiens
auauauuuuuuuuu

SEQ ID NO: 48009 - RNA, 15 nt, Homo sapiens
auauauuuuuuuuuu

SEQ ID NO: 48010 - RNA, 16 nt, Homo sapiens
auauauuuuuuuuuuu

SEQ ID NO: 48011 - RNA, 19 nt, Homo sapiens
auauauuuuuuuuuuuaaa

SEQ ID NO: 48012 - RNA, 20 nt, Homo sapiens
auauauuuuuuuuuuuaaaa

SEQ ID NO: 48013 - RNA, 18 nt, Homo sapiens
auaucaguuauuuuuaaa

SEQ ID NO: 48014 - RNA, 23 nt, Homo sapiens
auauccuaauaaaaaggugacca

SEQ ID NO: 48015 - RNA, 21 nt, Homo sapiens
auauccuuagcccaucuuuca

SEQ ID NO: 48016 - RNA, 22 nt, Homo sapiens
auauccuuagcccaucuuucaa

SEQ ID NO: 48017 - RNA, 18 nt, Homo sapiens
auaucuaauauauaugaa

SEQ ID NO: 48018 - RNA, 18 nt, Homo sapiens
auaucuagaaaugauaau

SEQ ID NO: 48019 - RNA, 17 nt, Homo sapiens
auaucuauauuuuacau

SEQ ID NO: 48020 - RNA, 20 nt, Homo sapiens
auaucuccgucaacucauau

SEQ ID NO: 48021 - RNA, 21 nt, Homo sapiens
auaucuccgucaacucauauu

SEQ ID NO: 48022 - RNA, 15 nt, Homo sapiens
auaugacacaucucu

SEQ ID NO: 48023 - RNA, 13 nt, Homo sapiens
auaugauucaaau

SEQ ID NO: 48024 - RNA, 20 nt, Homo sapiens
auaugcuucuguuuuauaau

SEQ ID NO: 48025 - RNA, 16 nt, Homo sapiens
auauguaacaacaauu

SEQ ID NO: 48026 - RNA, 12 nt, Homo sapiens
auaugugaaaua

SEQ ID NO: 48027 - RNA, 12 nt, Homo sapiens
auauuagcuuua

SEQ ID NO: 48028 - RNA, 18 nt, Homo sapiens
auauucauucuuuuugaa

SEQ ID NO: 48029 - RNA, 15 nt, Homo sapiens
auauugacuuuuuau

SEQ ID NO: 48030 - RNA, 16 nt, Homo sapiens
auauugauaauaaaau

SEQ ID NO: 48031 - RNA, 21 nt, Homo sapiens
auauuuaacaaaauuugaaua

SEQ ID NO: 48032 - RNA, 14 nt, Homo sapiens
auauuuaauuugaa

SEQ ID NO: 48033 - RNA, 21 nt, Homo sapiens
auauuuauugauguuuucaca

SEQ ID NO: 48034 - RNA, 16 nt, Homo sapiens
auauuuccaagaaaua

SEQ ID NO: 48035 - RNA, 11 nt, Homo sapiens
auauuuccuua

SEQ ID NO: 48036 - RNA, 12 nt, Homo sapiens
auauuugaaaua

SEQ ID NO: 48037 - RNA, 21 nt, Homo sapiens
auauuugaauuuuaaaucuaa

SEQ ID NO: 48038 - RNA, 15 nt, Homo sapiens
auauuuuacauaaau

SEQ ID NO: 48039 - RNA, 18 nt, Homo sapiens
auauuuuuaugugcaaua

SEQ ID NO: 48040 - RNA, 19 nt, Homo sapiens
auauuuuuaugugcaauaa

SEQ ID NO: 48041 - RNA, 22 nt, Homo sapiens
auauuuuuuguuaaaugauuuc

SEQ ID NO: 48042 - RNA, 15 nt, Homo sapiens
auauuuuuuuuuuua

SEQ ID NO: 48043 - RNA, 16 nt, Homo sapiens
auauuuuuuuuuuuaa

SEQ ID NO: 48044 - RNA, 17 nt, Homo sapiens
auauuuuuuuuuuuaaa

SEQ ID NO: 48045 - RNA, 16 nt, Homo sapiens
aucaaauaugcaaagc

SEQ ID NO: 48046 - RNA, 16 nt, Homo sapiens
aucaaccaaauggagu

SEQ ID NO: 48047 - RNA, 19 nt, Homo sapiens
aucaauagaaggauguaca

SEQ ID NO: 48048 - RNA, 10 nt, Homo sapiens
aucaauaucu

SEQ ID NO: 48049 - RNA, 17 nt, Homo sapiens
aucaauccaagaacuua

SEQ ID NO: 48050 - RNA, 14 nt, Homo sapiens
aucaaugaaugaau

SEQ ID NO: 48051 - RNA, 21 nt, Homo sapiens
aucaauucuauuacgugcaau

SEQ ID NO: 48052 - RNA, 22 nt, Homo sapiens
aucaauucuauuacgugcaaua

SEQ ID NO: 48053 - RNA, 18 nt, Homo sapiens
aucacaguuuugguugcu

SEQ ID NO: 48054 - RNA, 23 nt, Homo sapiens
aucacaguuuugguugcuuuaau

SEQ ID NO: 48055 - RNA, 14 nt, Homo sapiens
aucaccaaggcuga

SEQ ID NO: 48056 - RNA, 13 nt, Homo sapiens
aucacuugaaccc

SEQ ID NO: 48057 - RNA, 23 nt, Homo sapiens
aucacuugaacccgggaggcaga

SEQ ID NO: 48058 - RNA, 15 nt, Homo sapiens
aucagcauuuuacua

SEQ ID NO: 48059 - RNA, 21 nt, Homo sapiens
aucagccuaguugaucagcuu

SEQ ID NO: 48060 - RNA, 15 nt, Homo sapiens
aucaggcuggccaac

SEQ ID NO: 48061 - RNA, 17 nt, Homo sapiens
aucaggcuggccaacgg

SEQ ID NO: 48062 - RNA, 20 nt, Homo sapiens
aucaggguuaguauugucca

SEQ ID NO: 48063 - RNA, 15 nt, Homo sapiens
aucaguaugaaaaug

SEQ ID NO: 48064 - RNA, 16 nt, Homo sapiens
aucaguaugaaaaugu

SEQ ID NO: 48065 - RNA, 17 nt, Homo sapiens
aucaguccaaagggcau

SEQ ID NO: 48066 - RNA, 15 nt, Homo sapiens
aucaguuacucugaa

SEQ ID NO: 48067 - RNA, 15 nt, Homo sapiens
aucaguuauuuuuaa

SEQ ID NO: 48068 - RNA, 13 nt, Homo sapiens
aucauaugggaua

SEQ ID NO: 48069 - RNA, 15 nt, Homo sapiens
aucaucacccagcac

SEQ ID NO: 48070 - RNA, 17 nt, Homo sapiens
aucaugaauuaguuuua

SEQ ID NO: 48071 - RNA, 20 nt, Homo sapiens
aucaugccccuguacuccag

SEQ ID NO: 48072 - RNA, 13 nt, Homo sapiens
aucauguauuuau

SEQ ID NO: 48073 - RNA, 13 nt, Homo sapiens
aucauuaaaguuc

SEQ ID NO: 48074 - RNA, 16 nt, Homo sapiens
aucauuaaaguucuag

SEQ ID NO: 48075 - RNA, 20 nt, Homo sapiens
aucauuuacuuuuaaacuuu

SEQ ID NO: 48076 - RNA, 21 nt, Homo sapiens
aucauuucaaaacucauuucc

SEQ ID NO: 48077 - RNA, 17 nt, Homo sapiens
auccaaagcugaauaca

SEQ ID NO: 48078 - RNA, 16 nt, Homo sapiens
auccacacugagcuga

SEQ ID NO: 48079 - RNA, 19 nt, Homo sapiens
auccacuuuccaauaaaga

SEQ ID NO: 48080 - RNA, 16 nt, Homo sapiens
auccagaaauaaugaa

SEQ ID NO: 48081 - RNA, 17 nt, Homo sapiens
auccaguuacugccggu

SEQ ID NO: 48082 - RNA, 14 nt, Homo sapiens
auccauacauuugu

SEQ ID NO: 48083 - RNA, 17 nt, Homo sapiens
aucccacccgcccaccg

SEQ ID NO: 48084 - RNA, 20 nt, Homo sapiens
auccccguguuacugccuau

SEQ ID NO: 48085 - RNA, 14 nt, Homo sapiens
aucccggccggcgc

SEQ ID NO: 48086 - RNA, 17 nt, Homo sapiens
aucccggccggcgcgcu

SEQ ID NO: 48087 - RNA, 19 nt, Homo sapiens
aucccggccggcgcgcuca

SEQ ID NO: 48088 - RNA, 22 nt, Homo sapiens
auccgcccaucuccgucuccca

SEQ ID NO: 48089 - RNA, 19 nt, Homo sapiens
auccuaauaaaaaggugac

SEQ ID NO: 48090 - RNA, 21 nt, Homo sapiens
auccuaauaaaaaggugacca

SEQ ID NO: 48091 - RNA, 22 nt, Homo sapiens
auccuaauaaaaaggugaccau

SEQ ID NO: 48092 - RNA, 13 nt, Homo sapiens
auccuccuccugc

SEQ ID NO: 48093 - RNA, 23 nt, Homo sapiens
auccugauucauauuuaauuuga

SEQ ID NO: 48094 - RNA, 19 nt, Homo sapiens
auccugcaauuccacuuau

SEQ ID NO: 48095 - RNA, 15 nt, Homo sapiens
auccuggaauaucuc

SEQ ID NO: 48096 - RNA, 16 nt, Homo sapiens
auccuggaauaucucc

SEQ ID NO: 48097 - RNA, 14 nt, Homo sapiens
auccuucagccuga

SEQ ID NO: 48098 - RNA, 15 nt, Homo sapiens
auccuucagccugaa

SEQ ID NO: 48099 - RNA, 23 nt, Homo sapiens
aucggaucuggggcucugggaua

SEQ ID NO: 48100 - RNA, 21 nt, Homo sapiens
aucgucacugcuuaacuucac

SEQ ID NO: 48101 - RNA, 12 nt, Homo sapiens
aucuacacucca

SEQ ID NO: 48102 - RNA, 17 nt, Homo sapiens
aucuacacuccagugag

SEQ ID NO: 48103 - RNA, 15 nt, Homo sapiens
aucuauauuuuacau

SEQ ID NO: 48104 - RNA, 13 nt, Homo sapiens
aucuauuuauuaa

SEQ ID NO: 48105 - RNA, 12 nt, Homo sapiens
aucucaauauuu

SEQ ID NO: 48106 - RNA, 18 nt, Homo sapiens
aucucacaagcacuuucc

SEQ ID NO: 48107 - RNA, 19 nt, Homo sapiens
aucucacaagcacuuuccc

SEQ ID NO: 48108 - RNA, 17 nt, Homo sapiens
aucucauuuaauccucu

SEQ ID NO: 48109 - RNA, 14 nt, Homo sapiens
aucuccgucaacuc

SEQ ID NO: 48110 - RNA, 17 nt, Homo sapiens
aucugacaucucugcaa

SEQ ID NO: 48111 - RNA, 19 nt, Homo sapiens
aucugacaucucugcaauc

SEQ ID NO: 48112 - RNA, 14 nt, Homo sapiens
aucugcuaugcuau

SEQ ID NO: 48113 - RNA, 18 nt, Homo sapiens
aucuguaaaauggagaca

SEQ ID NO: 48114 - RNA, 22 nt, Homo sapiens
aucuguaaaauggagacaccac

SEQ ID NO: 48115 - RNA, 14 nt, Homo sapiens
aucuuacugaaggu

SEQ ID NO: 48116 - RNA, 14 nt, Homo sapiens
aucuucacuuuuau

SEQ ID NO: 48117 - RNA, 22 nt, Homo sapiens
aucuucacuuuuauaagaaaua

SEQ ID NO: 48118 - RNA, 22 nt, Homo sapiens
aucuucucagaaggcaaaugac

SEQ ID NO: 48119 - RNA, 16 nt, Homo sapiens
aucuucuuucaugaag

SEQ ID NO: 48120 - RNA, 15 nt, Homo sapiens
aucuugucucugggc

SEQ ID NO: 48121 - RNA, 15 nt, Homo sapiens
aucuuguuuuuccac

SEQ ID NO: 48122 - RNA, 22 nt, Homo sapiens
aucuuguuuuuccacuacugcu

SEQ ID NO: 48123 - RNA, 23 nt, Homo sapiens
aucuuguuuuuccacuacugcua

SEQ ID NO: 48124 - RNA, 24 nt, Homo sapiens
aucuuguuuuuccacuacugcuac

SEQ ID NO: 48125 - RNA, 21 nt, Homo sapiens
aucuuuaaaauacacacucaa

SEQ ID NO: 48126 - RNA, 15 nt, Homo sapiens
aucuuuauaguucua

SEQ ID NO: 48127 - RNA, 19 nt, Homo sapiens
aucuuuauaguucuacucc

SEQ ID NO: 48128 - RNA, 20 nt, Homo sapiens
aucuuucaagggaccucucc

SEQ ID NO: 48129 - RNA, 22 nt, Homo sapiens
aucuuucaagggaccucuccau

SEQ ID NO: 48130 - RNA, 11 nt, Homo sapiens
aucuuucacau

SEQ ID NO: 48131 - RNA, 18 nt, Homo sapiens
augaaaagauuaugaucu

SEQ ID NO: 48132 - RNA, 20 nt, Homo sapiens
augaaaagauuaugaucuca

SEQ ID NO: 48133 - RNA, 14 nt, Homo sapiens
augaaaaugaauau

SEQ ID NO: 48134 - RNA, 13 nt, Homo sapiens
augaaaaugucau

SEQ ID NO: 48135 - RNA, 20 nt, Homo sapiens
augaacacuuauaagugaag

SEQ ID NO: 48136 - RNA, 14 nt, Homo sapiens
augaagauacugaa

SEQ ID NO: 48137 - RNA, 17 nt, Homo sapiens
augaagauacugaaaua

SEQ ID NO: 48138 - RNA, 17 nt, Homo sapiens
augaaggggcggcggcc

SEQ ID NO: 48139 - RNA, 20 nt, Homo sapiens
augaaggggcggcggcccug

SEQ ID NO: 48140 - RNA, 17 nt, Homo sapiens
augaaguacucauacau

SEQ ID NO: 48141 - RNA, 15 nt, Homo sapiens
augaaguccaagcau

SEQ ID NO: 48142 - RNA, 16 nt, Homo sapiens
augaauaaaguguaag

SEQ ID NO: 48143 - RNA, 13 nt, Homo sapiens
augaauaucaguu

SEQ ID NO: 48144 - RNA, 18 nt, Homo sapiens
augaauuaaguuuuuuuu

SEQ ID NO: 48145 - RNA, 22 nt, Homo sapiens
augaauuaaguuuuuuuuuaaa

SEQ ID NO: 48146 - RNA, 19 nt, Homo sapiens
augaauuuuuuucaucuuc

SEQ ID NO: 48147 - RNA, 14 nt, Homo sapiens
augacaaagacuga

SEQ ID NO: 48148 - RNA, 13 nt, Homo sapiens
augacacaucucu

SEQ ID NO: 48149 - RNA, 21 nt, Homo sapiens
augacccccaucccauggggg

SEQ ID NO: 48150 - RNA, 13 nt, Homo sapiens
augaccuggccgc

SEQ ID NO: 48151 - RNA, 14 nt, Homo sapiens
augacgugacuggc

SEQ ID NO: 48152 - RNA, 21 nt, Homo sapiens
augacgugacuggccugcugg

SEQ ID NO: 48153 - RNA, 22 nt, Homo sapiens
augacgugacuggccugcugga

SEQ ID NO: 48154 - RNA, 14 nt, Homo sapiens
augacuuacuguac

SEQ ID NO: 48155 - RNA, 15 nt, Homo sapiens
augacuucauuaaua

SEQ ID NO: 48156 - RNA, 20 nt, Homo sapiens
augagaaucagaucauuuca

SEQ ID NO: 48157 - RNA, 13 nt, Homo sapiens
augagagacacac

SEQ ID NO: 48158 - RNA, 13 nt, Homo sapiens
augagaucauugu

SEQ ID NO: 48159 - RNA, 17 nt, Homo sapiens
augagccuuuguugcua

SEQ ID NO: 48160 - RNA, 15 nt, Homo sapiens
augauaacuggaaac

SEQ ID NO: 48161 - RNA, 13 nt, Homo sapiens
augauccugcaau

SEQ ID NO: 48162 - RNA, 11 nt, Homo sapiens
augauguuuca

SEQ ID NO: 48163 - RNA, 11 nt, Homo sapiens
augauguuucg

SEQ ID NO: 48164 - RNA, 14 nt, Homo sapiens
augauucaaauguc

SEQ ID NO: 48165 - RNA, 15 nt, Homo sapiens
augauuucacagugu

SEQ ID NO: 48166 - RNA, 16 nt, Homo sapiens
augauuucacagugug

SEQ ID NO: 48167 - RNA, 13 nt, Homo sapiens
augauuucauuca

SEQ ID NO: 48168 - RNA, 14 nt, Homo sapiens
augcaaagcacuga

SEQ ID NO: 48169 - RNA, 24 nt, Homo sapiens
augcaaccuuuggaugcacuuuau

SEQ ID NO: 48170 - RNA, 13 nt, Homo sapiens
augcacacauuuu

SEQ ID NO: 48171 - RNA, 14 nt, Homo sapiens
augcacacauuuuu

SEQ ID NO: 48172 - RNA, 22 nt, Homo sapiens
augcacagaguuguuacauuuu

SEQ ID NO: 48173 - RNA, 23 nt, Homo sapiens
augcacagaguuguuacauuuuu

SEQ ID NO: 48174 - RNA, 19 nt, Homo sapiens
augcaguucugaagaagau

SEQ ID NO: 48175 - RNA, 20 nt, Homo sapiens
augcaucuuacugaagguaa

SEQ ID NO: 48176 - RNA, 21 nt, Homo sapiens
augcaugaaguaauaugcaca

SEQ ID NO: 48177 - RNA, 16 nt, Homo sapiens
augcauuugcacuauu

SEQ ID NO: 48178 - RNA, 17 nt, Homo sapiens
augccaaguuguuugag

SEQ ID NO: 48179 - RNA, 19 nt, Homo sapiens
augccacuaaauugacacu

SEQ ID NO: 48180 - RNA, 19 nt, Homo sapiens
augccagccacugugauag

SEQ ID NO: 48181 - RNA, 14 nt, Homo sapiens
augccccagggacc

SEQ ID NO: 48182 - RNA, 19 nt, Homo sapiens
augccuggugcuuccaaau

SEQ ID NO: 48183 - RNA, 17 nt, Homo sapiens
augcuaauuuuauuaua

SEQ ID NO: 48184 - RNA, 13 nt, Homo sapiens
augcuauuuauua

SEQ ID NO: 48185 - RNA, 14 nt, Homo sapiens
augcuauuuauuaa

SEQ ID NO: 48186 - RNA, 17 nt, Homo sapiens
augcucuccaaaccacu

SEQ ID NO: 48187 - RNA, 16 nt, Homo sapiens
augcugagcccggaaa

SEQ ID NO: 48188 - RNA, 23 nt, Homo sapiens
augcugagcccggaaacuccaca

SEQ ID NO: 48189 - RNA, 14 nt, Homo sapiens
augcuggccaggcu

SEQ ID NO: 48190 - RNA, 15 nt, Homo sapiens
augcuggccaggcug

SEQ ID NO: 48191 - RNA, 13 nt, Homo sapiens
augcuguauuuua

SEQ ID NO: 48192 - RNA, 22 nt, Homo sapiens
augcuguauuuuaaaagaauga

SEQ ID NO: 48193 - RNA, 22 nt, Homo sapiens
augcuuaugaaacuaagauuug

SEQ ID NO: 48194 - RNA, 17 nt, Homo sapiens
augcuucuguuuuauaa

SEQ ID NO: 48195 - RNA, 15 nt, Homo sapiens
augcuuguacauaau

SEQ ID NO: 48196 - RNA, 18 nt, Homo sapiens
augcuuguauuuuacuuu

SEQ ID NO: 48197 - RNA, 20 nt, Homo sapiens
augcuuuaaacauugguucu

SEQ ID NO: 48198 - RNA, 20 nt, Homo sapiens
auggaauuucucccagucau

SEQ ID NO: 48199 - RNA, 12 nt, Homo sapiens
auggagacacca

SEQ ID NO: 48200 - RNA, 15 nt, Homo sapiens
auggagacaccacca

SEQ ID NO: 48201 - RNA, 16 nt, Homo sapiens
auggagacaccaccac

SEQ ID NO: 48202 - RNA, 18 nt, Homo sapiens
auggagacaccaccaccc

SEQ ID NO: 48203 - RNA, 17 nt, Homo sapiens
auggagguuaagcacuu

SEQ ID NO: 48204 - RNA, 14 nt, Homo sapiens
auggagugacuuag

SEQ ID NO: 48205 - RNA, 13 nt, Homo sapiens
auggcaagaugug

SEQ ID NO: 48206 - RNA, 14 nt, Homo sapiens
auggcaagaugugg

SEQ ID NO: 48207 - RNA, 17 nt, Homo sapiens
auggcacuaguauuucu

SEQ ID NO: 48208 - RNA, 18 nt, Homo sapiens
auggcacuaguauuucua

SEQ ID NO: 48209 - RNA, 20 nt, Homo sapiens
auggcaggaggcauccaaag

SEQ ID NO: 48210 - RNA, 17 nt, Homo sapiens
auggcaggcaucgccau

SEQ ID NO: 48211 - RNA, 22 nt, Homo sapiens
auggccagugagaucaauguga

SEQ ID NO: 48212 - RNA, 16 nt, Homo sapiens
auggcuaguaucaaaa

SEQ ID NO: 48213 - RNA, 12 nt, Homo sapiens
auggcuuccugg

SEQ ID NO: 48214 - RNA, 22 nt, Homo sapiens
auggcuuccuggcaauagucaa

SEQ ID NO: 48215 - RNA, 15 nt, Homo sapiens
auggcuuuugugcau

SEQ ID NO: 48216 - RNA, 13 nt, Homo sapiens
augggacauuugc

SEQ ID NO: 48217 - RNA, 21 nt, Homo sapiens
augggacauuugcucauggaa

SEQ ID NO: 48218 - RNA, 19 nt, Homo sapiens
augggagaaucacuugaac

SEQ ID NO: 48219 - RNA, 19 nt, Homo sapiens
augggcuuucccaacagcu

SEQ ID NO: 48220 - RNA, 16 nt, Homo sapiens
augggggugcauuuga

SEQ ID NO: 48221 - RNA, 19 nt, Homo sapiens
augguaguuuuacaguguu

SEQ ID NO: 48222 - RNA, 13 nt, Homo sapiens
augguauuaaaga

SEQ ID NO: 48223 - RNA, 21 nt, Homo sapiens
auggucggaaaacaugcuaca

SEQ ID NO: 48224 - RNA, 14 nt, Homo sapiens
auggugguauguuu

SEQ ID NO: 48225 - RNA, 19 nt, Homo sapiens
augguuccauucucucucc

SEQ ID NO: 48226 - RNA, 18 nt, Homo sapiens
augguuuaaauggucaau

SEQ ID NO: 48227 - RNA, 13 nt, Homo sapiens
auguaacugcauu

SEQ ID NO: 48228 - RNA, 17 nt, Homo sapiens
auguaauuauauauacu

SEQ ID NO: 48229 - RNA, 22 nt, Homo sapiens
auguacauccauggugugcugg

SEQ ID NO: 48230 - RNA, 21 nt, Homo sapiens
auguagaauauauuuccuuau

SEQ ID NO: 48231 - RNA, 18 nt, Homo sapiens
auguagauaaacucagaa

SEQ ID NO: 48232 - RNA, 17 nt, Homo sapiens
auguagauaaagcacug

SEQ ID NO: 48233 - RNA, 14 nt, Homo sapiens
auguagcagcucau

SEQ ID NO: 48234 - RNA, 16 nt, Homo sapiens
auguagcagcucauaa

SEQ ID NO: 48235 - RNA, 18 nt, Homo sapiens
auguauguacuucaugcu

SEQ ID NO: 48236 - RNA, 19 nt, Homo sapiens
augucauuguucuugugaa

SEQ ID NO: 48237 - RNA, 15 nt, Homo sapiens
augugacggcaggga

SEQ ID NO: 48238 - RNA, 17 nt, Homo sapiens
augugauauguaccuaa

SEQ ID NO: 48239 - RNA, 20 nt, Homo sapiens
augugauuacccucuggguc

SEQ ID NO: 48240 - RNA, 10 nt, Homo sapiens
augugcaaua

SEQ ID NO: 48241 - RNA, 11 nt, Homo sapiens
augugcaauaa

SEQ ID NO: 48242 - RNA, 11 nt, Homo sapiens
augugcaauau

SEQ ID NO: 48243 - RNA, 20 nt, Homo sapiens
augugcauauuuuauuauag

SEQ ID NO: 48244 - RNA, 23 nt, Homo sapiens
augugcuuuuaaaaaaaaauacu

SEQ ID NO: 48245 - RNA, 21 nt, Homo sapiens
auguggagggggcgcgugcag

SEQ ID NO: 48246 - RNA, 15 nt, Homo sapiens
auguguaagacaaaa

SEQ ID NO: 48247 - RNA, 22 nt, Homo sapiens
augugucaggugacccugauga

SEQ ID NO: 48248 - RNA, 17 nt, Homo sapiens
auguuaaaacugggaca

SEQ ID NO: 48249 - RNA, 17 nt, Homo sapiens
auguuagagaauuuccu

SEQ ID NO: 48250 - RNA, 18 nt, Homo sapiens
auguuagagaauuuccuu

SEQ ID NO: 48251 - RNA, 20 nt, Homo sapiens
auguuagagaauuuccuuac

SEQ ID NO: 48252 - RNA, 16 nt, Homo sapiens
auguugacaugggaca

SEQ ID NO: 48253 - RNA, 16 nt, Homo sapiens
auguuuagcagauuua

SEQ ID NO: 48254 - RNA, 17 nt, Homo sapiens
auguuuagcagauuuaa

SEQ ID NO: 48255 - RNA, 19 nt, Homo sapiens
auguuuagcagauuuaaga

SEQ ID NO: 48256 - RNA, 23 nt, Homo sapiens
auguuucaaacauauauaacaau

SEQ ID NO: 48257 - RNA, 15 nt, Homo sapiens
auguuucgcugauau

SEQ ID NO: 48258 - RNA, 23 nt, Homo sapiens
auguuucgugaaguauacuguau

SEQ ID NO: 48259 - RNA, 14 nt, Homo sapiens
auguuucuugggga

SEQ ID NO: 48260 - RNA, 22 nt, Homo sapiens
auguuugccgcuuaagcuuuca

SEQ ID NO: 48261 - RNA, 10 nt, Homo sapiens
auguuuucaa

SEQ ID NO: 48262 - RNA, 19 nt, Homo sapiens
auguuuucaggcuagaugu

SEQ ID NO: 48263 - RNA, 13 nt, Homo sapiens
auuaaagaucugc

SEQ ID NO: 48264 - RNA, 14 nt, Homo sapiens
auuaaaguucuagu

SEQ ID NO: 48265 - RNA, 15 nt, Homo sapiens
auuaaaguucuagug

SEQ ID NO: 48266 - RNA, 16 nt, Homo sapiens
auuaaaguucuaguga

SEQ ID NO: 48267 - RNA, 12 nt, Homo sapiens
auuaaauaaaau

SEQ ID NO: 48268 - RNA, 20 nt, Homo sapiens
auuaaauggaaguaaauguu

SEQ ID NO: 48269 - RNA, 20 nt, Homo sapiens
auuaacuuuuauaaacuuua

SEQ ID NO: 48270 - RNA, 15 nt, Homo sapiens
auuaaggauuuuaug

SEQ ID NO: 48271 - RNA, 15 nt, Homo sapiens
auuaaggcuucucuu

SEQ ID NO: 48272 - RNA, 15 nt, Homo sapiens
auuaaggguaugauu

SEQ ID NO: 48273 - RNA, 13 nt, Homo sapiens
auuaaguaaugau

SEQ ID NO: 48274 - RNA, 21 nt, Homo sapiens
auuaaguuuuuuuuuaaaaaa

SEQ ID NO: 48275 - RNA, 12 nt, Homo sapiens
auuaauucaccu

SEQ ID NO: 48276 - RNA, 19 nt, Homo sapiens
auuacaaggcuuuaucuca

SEQ ID NO: 48277 - RNA, 16 nt, Homo sapiens
auuacaggcgugagcc

SEQ ID NO: 48278 - RNA, 17 nt, Homo sapiens
auuacaggcgugagcca

SEQ ID NO: 48279 - RNA, 18 nt, Homo sapiens
auuacaggcgugagccac

SEQ ID NO: 48280 - RNA, 14 nt, Homo sapiens
auuacaucuuucac

SEQ ID NO: 48281 - RNA, 18 nt, Homo sapiens
auuacauuuguauaaaau

SEQ ID NO: 48282 - RNA, 13 nt, Homo sapiens
auuacgugcaaua

SEQ ID NO: 48283 - RNA, 19 nt, Homo sapiens
auuacgugcaauacuucaa

SEQ ID NO: 48284 - RNA, 20 nt, Homo sapiens
auuacuguaagaaaauauca

SEQ ID NO: 48285 - RNA, 21 nt, Homo sapiens
auuacuguaagaaaauaucac

SEQ ID NO: 48286 - RNA, 11 nt, Homo sapiens
auuagccgggc

SEQ ID NO: 48287 - RNA, 12 nt, Homo sapiens
auuagccgggca

SEQ ID NO: 48288 - RNA, 12 nt, Homo sapiens
auuagccgggcg

SEQ ID NO: 48289 - RNA, 19 nt, Homo sapiens
auuagugaaguaugcacua

SEQ ID NO: 48290 - RNA, 13 nt, Homo sapiens
auuauagaaugga

SEQ ID NO: 48291 - RNA, 15 nt, Homo sapiens
auuauauuuauuacu

SEQ ID NO: 48292 - RNA, 13 nt, Homo sapiens
auuaucaugcaaa

SEQ ID NO: 48293 - RNA, 18 nt, Homo sapiens
auuaucuagauacuguau

SEQ ID NO: 48294 - RNA, 21 nt, Homo sapiens
auuauucccauucuacauacu

SEQ ID NO: 48295 - RNA, 16 nt, Homo sapiens
auuauuugaagauuua

SEQ ID NO: 48296 - RNA, 19 nt, Homo sapiens
auuauuugaagauuuaauu

SEQ ID NO: 48297 - RNA, 20 nt, Homo sapiens
auuauuugaagauuuaauua

SEQ ID NO: 48298 - RNA, 19 nt, Homo sapiens
auuauuuuagagcaucuca

SEQ ID NO: 48299 - RNA, 20 nt, Homo sapiens
auuauuuuagagcaucucau

SEQ ID NO: 48300 - RNA, 14 nt, Homo sapiens
auucaaaaguugaa

SEQ ID NO: 48301 - RNA, 11 nt, Homo sapiens
auucaaaugua

SEQ ID NO: 48302 - RNA, 18 nt, Homo sapiens
auucaaauguauuacagu

SEQ ID NO: 48303 - RNA, 23 nt, Homo sapiens
auucagaauuucuaaaaguuuaa

SEQ ID NO: 48304 - RNA, 12 nt, Homo sapiens
auucaggaugcc

SEQ ID NO: 48305 - RNA, 14 nt, Homo sapiens
auucauauuuaauu

SEQ ID NO: 48306 - RNA, 20 nt, Homo sapiens
auucauauuuauagccaggu

SEQ ID NO: 48307 - RNA, 14 nt, Homo sapiens
auucauuccauuug

SEQ ID NO: 48308 - RNA, 23 nt, Homo sapiens
auucauucuuuuugaaaugucaa

SEQ ID NO: 48309 - RNA, 17 nt, Homo sapiens
auuccaacuaucucauu

SEQ ID NO: 48310 - RNA, 14 nt, Homo sapiens
auuccaagccugac

SEQ ID NO: 48311 - RNA, 13 nt, Homo sapiens
auucccauucuac

SEQ ID NO: 48312 - RNA, 16 nt, Homo sapiens
auucccuccugcuacu

SEQ ID NO: 48313 - RNA, 12 nt, Homo sapiens
auuccuauaucc

SEQ ID NO: 48314 - RNA, 15 nt, Homo sapiens
auuccucacuuugaa

SEQ ID NO: 48315 - RNA, 16 nt, Homo sapiens
auucgauccccuguca

SEQ ID NO: 48316 - RNA, 14 nt, Homo sapiens
auucuauguuaaua

SEQ ID NO: 48317 - RNA, 18 nt, Homo sapiens
auucuauuacgugcaaua

SEQ ID NO: 48318 - RNA, 19 nt, Homo sapiens
auucuauuacgugcaauac

SEQ ID NO: 48319 - RNA, 21 nt, Homo sapiens
auucugagguaaccucauuau

SEQ ID NO: 48320 - RNA, 23 nt, Homo sapiens
auucugagguaaccucauuauca

SEQ ID NO: 48321 - RNA, 17 nt, Homo sapiens
auucugcaagcuuuuca

SEQ ID NO: 48322 - RNA, 14 nt, Homo sapiens
auucuuccucccau

SEQ ID NO: 48323 - RNA, 15 nt, Homo sapiens
auucuuccucccauu

SEQ ID NO: 48324 - RNA, 21 nt, Homo sapiens
auucuuccucccauucaggau

SEQ ID NO: 48325 - RNA, 14 nt, Homo sapiens
auucuuuaucacau

SEQ ID NO: 48326 - RNA, 13 nt, Homo sapiens
auucuuuuaguuu

SEQ ID NO: 48327 - RNA, 19 nt, Homo sapiens
auucuuuuugaaaugucaa

SEQ ID NO: 48328 - RNA, 16 nt, Homo sapiens
auugaaaugauuucac

SEQ ID NO: 48329 - RNA, 21 nt, Homo sapiens
auugaaucccuuaaacucagg

SEQ ID NO: 48330 - RNA, 18 nt, Homo sapiens
auugacuauagugugagc

SEQ ID NO: 48331 - RNA, 15 nt, Homo sapiens
auugagaacugcaua

SEQ ID NO: 48332 - RNA, 14 nt, Homo sapiens
auugagaaggagcu

SEQ ID NO: 48333 - RNA, 16 nt, Homo sapiens
auugagcaccugcagg

SEQ ID NO: 48334 - RNA, 14 nt, Homo sapiens
auugcaaccuccac

SEQ ID NO: 48335 - RNA, 13 nt, Homo sapiens
auugcauuuaauu

SEQ ID NO: 48336 - RNA, 17 nt, Homo sapiens
auugcauuuaauuuauu

SEQ ID NO: 48337 - RNA, 18 nt, Homo sapiens
auugcauuuaauuuauug

SEQ ID NO: 48338 - RNA, 15 nt, Homo sapiens
auugcuaucgccauc

SEQ ID NO: 48339 - RNA, 23 nt, Homo sapiens
auuggacuuaaaaucuaauucaa

SEQ ID NO: 48340 - RNA, 18 nt, Homo sapiens
auuggagcucgugggaca

SEQ ID NO: 48341 - RNA, 18 nt, Homo sapiens
auuggcuagagguucaaa

SEQ ID NO: 48342 - RNA, 17 nt, Homo sapiens
auugguugggcugagca

SEQ ID NO: 48343 - RNA, 13 nt, Homo sapiens
auugguuuaccug

SEQ ID NO: 48344 - RNA, 17 nt, Homo sapiens
auuguaacuuaugaacc

SEQ ID NO: 48345 - RNA, 14 nt, Homo sapiens
auugucuagugaaa

SEQ ID NO: 48346 - RNA, 14 nt, Homo sapiens
auugugggcucugg

SEQ ID NO: 48347 - RNA, 12 nt, Homo sapiens
auuguugacaac

SEQ ID NO: 48348 - RNA, 17 nt, Homo sapiens
auuguugacaacuguga

SEQ ID NO: 48349 - RNA, 18 nt, Homo sapiens
auuguugacaacugugac

SEQ ID NO: 48350 - RNA, 15 nt, Homo sapiens
auuuaaagacaaaga

SEQ ID NO: 48351 - RNA, 23 nt, Homo sapiens
auuuaaauagcuuuuuucucuga

SEQ ID NO: 48352 - RNA, 22 nt, Homo sapiens
auuuaaccucuaaauucuuuca

SEQ ID NO: 48353 - RNA, 17 nt, Homo sapiens
auuuaagagaacaagca

SEQ ID NO: 48354 - RNA, 13 nt, Homo sapiens
auuuaagauaugu

SEQ ID NO: 48355 - RNA, 15 nt, Homo sapiens
auuuaauccucucaa

SEQ ID NO: 48356 - RNA, 22 nt, Homo sapiens
auuuaauuacuucuuaguaugu

SEQ ID NO: 48357 - RNA, 18 nt, Homo sapiens
auuuacggaacucaaaua

SEQ ID NO: 48358 - RNA, 19 nt, Homo sapiens
auuuacggaacucaaauac

SEQ ID NO: 48359 - RNA, 18 nt, Homo sapiens
auuuaguauuuuguuuca

SEQ ID NO: 48360 - RNA, 16 nt, Homo sapiens
auuuaucauuuaguua

SEQ ID NO: 48361 - RNA, 17 nt, Homo sapiens
auuuauuaccucugaua

SEQ ID NO: 48362 - RNA, 18 nt, Homo sapiens
auuuauugaaaugauuuc

SEQ ID NO: 48363 - RNA, 19 nt, Homo sapiens
auuuauugaaaugauuuca

SEQ ID NO: 48364 - RNA, 21 nt, Homo sapiens
auuuauugaaaugauuucaca

SEQ ID NO: 48365 - RNA, 14 nt, Homo sapiens
auuuauugagcacc

SEQ ID NO: 48366 - RNA, 18 nt, Homo sapiens
auuuauugagcaccugca

SEQ ID NO: 48367 - RNA, 14 nt, Homo sapiens
auuuauuuauucau

SEQ ID NO: 48368 - RNA, 11 nt, Homo sapiens
auuuauuuuaa

SEQ ID NO: 48369 - RNA, 12 nt, Homo sapiens
auuuauuuuaau

SEQ ID NO: 48370 - RNA, 13 nt, Homo sapiens
auuuauuuuaaua

SEQ ID NO: 48371 - RNA, 17 nt, Homo sapiens
auuuauuuuuuuacuuc

SEQ ID NO: 48372 - RNA, 20 nt, Homo sapiens
auuuauuuuuuuacuuccuc

SEQ ID NO: 48373 - RNA, 14 nt, Homo sapiens
auuucacuugauga

SEQ ID NO: 48374 - RNA, 21 nt, Homo sapiens
auuucauaccuaucaucuuaa

SEQ ID NO: 48375 - RNA, 16 nt, Homo sapiens
auuuccaaauucacaa

SEQ ID NO: 48376 - RNA, 22 nt, Homo sapiens
auuuccaagaaauauuccuuaa

SEQ ID NO: 48377 - RNA, 16 nt, Homo sapiens
auuuccaagcaaguau

SEQ ID NO: 48378 - RNA, 20 nt, Homo sapiens
auuuccguuaaaauaccagc

SEQ ID NO: 48379 - RNA, 18 nt, Homo sapiens
auuucuaaaucuccaaaa

SEQ ID NO: 48380 - RNA, 23 nt, Homo sapiens
auuucuaaaucuccaaaauaaaa

SEQ ID NO: 48381 - RNA, 13 nt, Homo sapiens
auuucuaugaaau

SEQ ID NO: 48382 - RNA, 14 nt, Homo sapiens
auuucuaugaaaua

SEQ ID NO: 48383 - RNA, 22 nt, Homo sapiens
auuucugaggagccugcaacau

SEQ ID NO: 48384 - RNA, 15 nt, Homo sapiens
auuucugcaucagcu

SEQ ID NO: 48385 - RNA, 13 nt, Homo sapiens
auuucugcuuuca

SEQ ID NO: 48386 - RNA, 22 nt, Homo sapiens
auuucuuuugccguuauuaaaa

SEQ ID NO: 48387 - RNA, 21 nt, Homo sapiens
auuugaaauauugacuuuuua

SEQ ID NO: 48388 - RNA, 13 nt, Homo sapiens
auuugaauauaaa

SEQ ID NO: 48389 - RNA, 14 nt, Homo sapiens
auuugaauauaaau

SEQ ID NO: 48390 - RNA, 21 nt, Homo sapiens
auuugaauauaaauuuaucau

SEQ ID NO: 48391 - RNA, 22 nt, Homo sapiens
auuugaauauaaauuuaucauu

SEQ ID NO: 48392 - RNA, 11 nt, Homo sapiens
auuugagacag

SEQ ID NO: 48393 - RNA, 14 nt, Homo sapiens
auuugagacaggga

SEQ ID NO: 48394 - RNA, 21 nt, Homo sapiens
auuugagcucuggaagccucu

SEQ ID NO: 48395 - RNA, 17 nt, Homo sapiens
auuugccaauuuacuuu

SEQ ID NO: 48396 - RNA, 19 nt, Homo sapiens
auuugcuguuauuuuaucu

SEQ ID NO: 48397 - RNA, 11 nt, Homo sapiens
auuugguucua

SEQ ID NO: 48398 - RNA, 15 nt, Homo sapiens
auuugguuuucacau

SEQ ID NO: 48399 - RNA, 13 nt, Homo sapiens
auuuguauaaaau

SEQ ID NO: 48400 - RNA, 24 nt, Homo sapiens
auuuguuugcauaggugaucucau

SEQ ID NO: 48401 - RNA, 13 nt, Homo sapiens
auuuuacauaaau

SEQ ID NO: 48402 - RNA, 14 nt, Homo sapiens
auuuuacauaaauu

SEQ ID NO: 48403 - RNA, 21 nt, Homo sapiens
auuuuagagcaucucauuuau

SEQ ID NO: 48404 - RNA, 15 nt, Homo sapiens
auuuuagcuacuaua

SEQ ID NO: 48405 - RNA, 13 nt, Homo sapiens
auuuuaggucaaa

SEQ ID NO: 48406 - RNA, 14 nt, Homo sapiens
auuuuaggucaaac

SEQ ID NO: 48407 - RNA, 15 nt, Homo sapiens
auuuuaucugcuaug

SEQ ID NO: 48408 - RNA, 15 nt, Homo sapiens
auuuuaugcuuuaaa

SEQ ID NO: 48409 - RNA, 18 nt, Homo sapiens
auuuuauuacaucuuuca

SEQ ID NO: 48410 - RNA, 13 nt, Homo sapiens
auuuucaccuguu

SEQ ID NO: 48411 - RNA, 19 nt, Homo sapiens
auuuucaugcuguucauga

SEQ ID NO: 48412 - RNA, 15 nt, Homo sapiens
auuuuccugaaaacc

SEQ ID NO: 48413 - RNA, 12 nt, Homo sapiens
auuuucuuccaa

SEQ ID NO: 48414 - RNA, 20 nt, Homo sapiens
auuuuguguucaguacaauu

SEQ ID NO: 48415 - RNA, 22 nt, Homo sapiens
auuuuguuuuuaaacuggaaau

SEQ ID NO: 48416 - RNA, 21 nt, Homo sapiens
auuuuuaaacuguaaagcuuu

SEQ ID NO: 48417 - RNA, 12 nt, Homo sapiens
auuuuuauauuu

SEQ ID NO: 48418 - RNA, 18 nt, Homo sapiens
auuuuucagauauaaaag

SEQ ID NO: 48419 - RNA, 23 nt, Homo sapiens
auuuuuccccaaaaagaauggga

SEQ ID NO: 48420 - RNA, 17 nt, Homo sapiens
auuuuucucaauguuua

SEQ ID NO: 48421 - RNA, 16 nt, Homo sapiens
auuuuucucuaacuca

SEQ ID NO: 48422 - RNA, 12 nt, Homo sapiens
auuuuuguaauu

SEQ ID NO: 48423 - RNA, 22 nt, Homo sapiens
auuuuuguaauuuuuuuaucgu

SEQ ID NO: 48424 - RNA, 22 nt, Homo sapiens
auuuuuguuuucauuaucucaa

SEQ ID NO: 48425 - RNA, 23 nt, Homo sapiens
auuuuuuuacuaauagacaauuu

SEQ ID NO: 48426 - RNA, 22 nt, Homo sapiens
auuuuuuugugggaaauccaca

SEQ ID NO: 48427 - RNA, 12 nt, Homo sapiens
auuuuuuuucug

SEQ ID NO: 48428 - RNA, 17 nt, Homo sapiens
auuuuuuuucuguuaua

SEQ ID NO: 48429 - RNA, 22 nt, Homo sapiens
caaaaacacagcaagggugaug

SEQ ID NO: 48430 - RNA, 23 nt, Homo sapiens
caaaaacacagcaagggugaugg

SEQ ID NO: 48431 - RNA, 16 nt, Homo sapiens
caaaaauuagccgggc

SEQ ID NO: 48432 - RNA, 17 nt, Homo sapiens
caaaaauuagccgggca

SEQ ID NO: 48433 - RNA, 20 nt, Homo sapiens
caaaaauuauauuuugaaca

SEQ ID NO: 48434 - RNA, 20 nt, Homo sapiens
caaaacugauacccuuugaa

SEQ ID NO: 48435 - RNA, 17 nt, Homo sapiens
caaaacugcacugucaa

SEQ ID NO: 48436 - RNA, 17 nt, Homo sapiens
caaaacuucagacauag

SEQ ID NO: 48437 - RNA, 15 nt, Homo sapiens
caaaaucaaauucca

SEQ ID NO: 48438 - RNA, 15 nt, Homo sapiens
caaaauugggaaagg

SEQ ID NO: 48439 - RNA, 23 nt, Homo sapiens
caaacaaacgaaaaacauuucaa

SEQ ID NO: 48440 - RNA, 16 nt, Homo sapiens
caaacagucucaggaa

SEQ ID NO: 48441 - RNA, 22 nt, Homo sapiens
caaaccagagccugaguguugc

SEQ ID NO: 48442 - RNA, 15 nt, Homo sapiens
caaacccggccugau

SEQ ID NO: 48443 - RNA, 17 nt, Homo sapiens
caaaccucugugagcau

SEQ ID NO: 48444 - RNA, 19 nt, Homo sapiens
caaacgaaaaacauuucaa

SEQ ID NO: 48445 - RNA, 21 nt, Homo sapiens
caaagacaaauucuguuucuu

SEQ ID NO: 48446 - RNA, 19 nt, Homo sapiens
caaagaugaucaguaugaa

SEQ ID NO: 48447 - RNA, 17 nt, Homo sapiens
caaaggcuccugagaca

SEQ ID NO: 48448 - RNA, 12 nt, Homo sapiens
caaagugcuggg

SEQ ID NO: 48449 - RNA, 11 nt, Homo sapiens
caaagugugac

SEQ ID NO: 48450 - RNA, 19 nt, Homo sapiens
caaaguuaagaaucuuuau

SEQ ID NO: 48451 - RNA, 20 nt, Homo sapiens
caaaguuaagaaucuuuaua

SEQ ID NO: 48452 - RNA, 22 nt, Homo sapiens
caaauaaguauuuauaauagca

SEQ ID NO: 48453 - RNA, 20 nt, Homo sapiens
caaauacgugggcauucaaa

SEQ ID NO: 48454 - RNA, 15 nt, Homo sapiens
caaauaugcaaagca

SEQ ID NO: 48455 - RNA, 21 nt, Homo sapiens
caaauaugcaaagcacugacu

SEQ ID NO: 48456 - RNA, 16 nt, Homo sapiens
caaauauuguugacaa

SEQ ID NO: 48457 - RNA, 23 nt, Homo sapiens
caaauccuugaagauuuaccacu

SEQ ID NO: 48458 - RNA, 13 nt, Homo sapiens
caaaucucuauua

SEQ ID NO: 48459 - RNA, 18 nt, Homo sapiens
caaaucuuaacuugaagg

SEQ ID NO: 48460 - RNA, 16 nt, Homo sapiens
caaaugacccccaucc

SEQ ID NO: 48461 - RNA, 17 nt, Homo sapiens
caaauguucaucaauga

SEQ ID NO: 48462 - RNA, 12 nt, Homo sapiens
caaauucacaag

SEQ ID NO: 48463 - RNA, 12 nt, Homo sapiens
caaauuccagaa

SEQ ID NO: 48464 - RNA, 22 nt, Homo sapiens
caaauucgcugcaaccuguuga

SEQ ID NO: 48465 - RNA, 17 nt, Homo sapiens
caaauugagcuaggggg

SEQ ID NO: 48466 - RNA, 18 nt, Homo sapiens
caaauugagcuagggggg

SEQ ID NO: 48467 - RNA, 22 nt, Homo sapiens
caacaauuauuugaagauuuaa

SEQ ID NO: 48468 - RNA, 11 nt, Homo sapiens
caacacgagca

SEQ ID NO: 48469 - RNA, 13 nt, Homo sapiens
caacacgagcagg

SEQ ID NO: 48470 - RNA, 14 nt, Homo sapiens
caacacgagcaggc

SEQ ID NO: 48471 - RNA, 23 nt, Homo sapiens
caacacgagcaggcuacugucag

SEQ ID NO: 48472 - RNA, 22 nt, Homo sapiens
caacauacacaccccggacucc

SEQ ID NO: 48473 - RNA, 19 nt, Homo sapiens
caacaugccagccacugug

SEQ ID NO: 48474 - RNA, 14 nt, Homo sapiens
caaccaccuuucag

SEQ ID NO: 48475 - RNA, 15 nt, Homo sapiens
caaccacucauucaa

SEQ ID NO: 48476 - RNA, 18 nt, Homo sapiens
caaccacucauucaaaag

SEQ ID NO: 48477 - RNA, 19 nt, Homo sapiens
caacccaaauguucaucaa

SEQ ID NO: 48478 - RNA, 18 nt, Homo sapiens
caaccuccaccuucuggg

SEQ ID NO: 48479 - RNA, 21 nt, Homo sapiens
caacuauaaaacuaggugcug

SEQ ID NO: 48480 - RNA, 20 nt, Homo sapiens
caacuauauuaucaugcaaa

SEQ ID NO: 48481 - RNA, 14 nt, Homo sapiens
caacuauauuguuu

SEQ ID NO: 48482 - RNA, 18 nt, Homo sapiens
caacuggggugggugggg

SEQ ID NO: 48483 - RNA, 20 nt, Homo sapiens
caacugggguggguggggca

SEQ ID NO: 48484 - RNA, 13 nt, Homo sapiens
caacugugacugu

SEQ ID NO: 48485 - RNA, 18 nt, Homo sapiens
caagaaaauggccaguga

SEQ ID NO: 48486 - RNA, 23 nt, Homo sapiens
caagaaaauggccagugagauca

SEQ ID NO: 48487 - RNA, 19 nt, Homo sapiens
caagaaaugaaagcaggga

SEQ ID NO: 48488 - RNA, 12 nt, Homo sapiens
caagaacuuauu

SEQ ID NO: 48489 - RNA, 13 nt, Homo sapiens
caagacaaaugac

SEQ ID NO: 48490 - RNA, 10 nt, Homo sapiens
caagacauag

SEQ ID NO: 48491 - RNA, 16 nt, Homo sapiens
caagaccacguuucua

SEQ ID NO: 48492 - RNA, 15 nt, Homo sapiens
caagacccaaaaggc

SEQ ID NO: 48493 - RNA, 17 nt, Homo sapiens
caagacugcacaucaaa

SEQ ID NO: 48494 - RNA, 11 nt, Homo sapiens
caagcacuuuc

SEQ ID NO: 48495 - RNA, 13 nt, Homo sapiens
caagcacuuuccc

SEQ ID NO: 48496 - RNA, 21 nt, Homo sapiens
caagcaggcucaacauaacau

SEQ ID NO: 48497 - RNA, 13 nt, Homo sapiens
caagcauuuagau

SEQ ID NO: 48498 - RNA, 17 nt, Homo sapiens
caagcauuuagauguau

SEQ ID NO: 48499 - RNA, 12 nt, Homo sapiens
caagccagauuu

SEQ ID NO: 48500 - RNA, 17 nt, Homo sapiens
caagccaucggagcugc

SEQ ID NO: 48501 - RNA, 15 nt, Homo sapiens
caagccucaugucca

SEQ ID NO: 48502 - RNA, 14 nt, Homo sapiens
caagccugccucaa

SEQ ID NO: 48503 - RNA, 15 nt, Homo sapiens
caagcucacagaccu

SEQ ID NO: 48504 - RNA, 20 nt, Homo sapiens
caagcuuuucaaaauuggac

SEQ ID NO: 48505 - RNA, 16 nt, Homo sapiens
caaggcccccgggccg

SEQ ID NO: 48506 - RNA, 18 nt, Homo sapiens
caaggcccccgggccgac

SEQ ID NO: 48507 - RNA, 19 nt, Homo sapiens
caaggcccccgggccgacg

SEQ ID NO: 48508 - RNA, 20 nt, Homo sapiens
caaggcccccgggccgacgg

SEQ ID NO: 48509 - RNA, 21 nt, Homo sapiens
caaggcccccgggccgacgga

SEQ ID NO: 48510 - RNA, 22 nt, Homo sapiens
caaggcccccgggccgacggag

SEQ ID NO: 48511 - RNA, 23 nt, Homo sapiens
caaggcccccgggccgacggagc

SEQ ID NO: 48512 - RNA, 17 nt, Homo sapiens
caaggcuggagugcagu

SEQ ID NO: 48513 - RNA, 21 nt, Homo sapiens
caaggcuggagugcaguggcg

SEQ ID NO: 48514 - RNA, 22 nt, Homo sapiens
caaggcuggagugcaguggcgc

SEQ ID NO: 48515 - RNA, 18 nt, Homo sapiens
caaggcuuagacccucau

SEQ ID NO: 48516 - RNA, 21 nt, Homo sapiens
caaggcuuagacccucaugcu

SEQ ID NO: 48517 - RNA, 22 nt, Homo sapiens
caaggguacacugccuucucaa

SEQ ID NO: 48518 - RNA, 16 nt, Homo sapiens
caagucagucauucag

SEQ ID NO: 48519 - RNA, 12 nt, Homo sapiens
caaguccaagca

SEQ ID NO: 48520 - RNA, 18 nt, Homo sapiens
caaguccaagcauaccaa

SEQ ID NO: 48521 - RNA, 18 nt, Homo sapiens
caagugauccgcccaucu

SEQ ID NO: 48522 - RNA, 19 nt, Homo sapiens
caagugauccgcccaucuc

SEQ ID NO: 48523 - RNA, 20 nt, Homo sapiens
caaguucuuaguugcuguau

SEQ ID NO: 48524 - RNA, 21 nt, Homo sapiens
caaguucuuaguugcuguaug

SEQ ID NO: 48525 - RNA, 16 nt, Homo sapiens
caaguuguguuugaua

SEQ ID NO: 48526 - RNA, 17 nt, Homo sapiens
caaguuguguuugauau

SEQ ID NO: 48527 - RNA, 23 nt, Homo sapiens
caaguuguguuugauauccaaag

SEQ ID NO: 48528 - RNA, 17 nt, Homo sapiens
caaguuguuugagaaau

SEQ ID NO: 48529 - RNA, 22 nt, Homo sapiens
caauacauuauuggacuuccau

SEQ ID NO: 48530 - RNA, 21 nt, Homo sapiens
caauagaaggauguacauuuc

SEQ ID NO: 48531 - RNA, 21 nt, Homo sapiens
caauagucaaauugugugaaa

SEQ ID NO: 48532 - RNA, 14 nt, Homo sapiens
caauauccuaauaa

SEQ ID NO: 48533 - RNA, 19 nt, Homo sapiens
caauauucauagcagcuua

SEQ ID NO: 48534 - RNA, 16 nt, Homo sapiens
caauauuguacaguuu

SEQ ID NO: 48535 - RNA, 23 nt, Homo sapiens
caauauuuauuauuuucaccugu

SEQ ID NO: 48536 - RNA, 12 nt, Homo sapiens
caaucaucaacc

SEQ ID NO: 48537 - RNA, 13 nt, Homo sapiens
caaucaucaaccc

SEQ ID NO: 48538 - RNA, 14 nt, Homo sapiens
caaucaucaacccc

SEQ ID NO: 48539 - RNA, 18 nt, Homo sapiens
caaucaucaacccccaac

SEQ ID NO: 48540 - RNA, 16 nt, Homo sapiens
caauccugauucauau

SEQ ID NO: 48541 - RNA, 20 nt, Homo sapiens
caauccugauucauauuuaa

SEQ ID NO: 48542 - RNA, 21 nt, Homo sapiens
caaucugagccagugcuuuaa

SEQ ID NO: 48543 - RNA, 19 nt, Homo sapiens
caaucuuaacucauugcaa

SEQ ID NO: 48544 - RNA, 20 nt, Homo sapiens
caaucuucucagaaggcaaa

SEQ ID NO: 48545 - RNA, 16 nt, Homo sapiens
caaugaagucucugaa

SEQ ID NO: 48546 - RNA, 16 nt, Homo sapiens
caaugacuuacuguac

SEQ ID NO: 48547 - RNA, 15 nt, Homo sapiens
caaugcuguauuuua

SEQ ID NO: 48548 - RNA, 16 nt, Homo sapiens
caaugcuguauuuuaa

SEQ ID NO: 48549 - RNA, 19 nt, Homo sapiens
caauguuuagcagauuuaa

SEQ ID NO: 48550 - RNA, 17 nt, Homo sapiens
caauuauaucaguccuc

SEQ ID NO: 48551 - RNA, 19 nt, Homo sapiens
caauuauuugaagauuuaa

SEQ ID NO: 48552 - RNA, 20 nt, Homo sapiens
caauuauuuuuacaguucuc

SEQ ID NO: 48553 - RNA, 21 nt, Homo sapiens
caauuauuuuuacaguucucc

SEQ ID NO: 48554 - RNA, 13 nt, Homo sapiens
caauuccucuggg

SEQ ID NO: 48555 - RNA, 19 nt, Homo sapiens
caauucuauuacgugcaau

SEQ ID NO: 48556 - RNA, 20 nt, Homo sapiens
caauucuauuacgugcaaua

SEQ ID NO: 48557 - RNA, 21 nt, Homo sapiens
caauucuauuacgugcaauac

SEQ ID NO: 48558 - RNA, 20 nt, Homo sapiens
caauuuuaaggcauauuuaa

SEQ ID NO: 48559 - RNA, 14 nt, Homo sapiens
cacaaaauugggaa

SEQ ID NO: 48560 - RNA, 15 nt, Homo sapiens
cacaaccugucccag

SEQ ID NO: 48561 - RNA, 20 nt, Homo sapiens
cacaagugaaaaacauccag

SEQ ID NO: 48562 - RNA, 23 nt, Homo sapiens
cacaaguuguguuugauauccaa

SEQ ID NO: 48563 - RNA, 24 nt, Homo sapiens
cacaaguuguguuugauauccaaa

SEQ ID NO: 48564 - RNA, 11 nt, Homo sapiens
cacacacuuuu

SEQ ID NO: 48565 - RNA, 12 nt, Homo sapiens
cacacacuuuug

SEQ ID NO: 48566 - RNA, 17 nt, Homo sapiens
cacaccccagacgaugu

SEQ ID NO: 48567 - RNA, 22 nt, Homo sapiens
cacacucucccauuauauuuau

SEQ ID NO: 48568 - RNA, 12 nt, Homo sapiens
cacacugaagaa

SEQ ID NO: 48569 - RNA, 13 nt, Homo sapiens
cacacugaagaag

SEQ ID NO: 48570 - RNA, 14 nt, Homo sapiens
cacacugaagaagc

SEQ ID NO: 48571 - RNA, 17 nt, Homo sapiens
cacacugagcugagggg

SEQ ID NO: 48572 - RNA, 16 nt, Homo sapiens
cacagaggaucugcuu

SEQ ID NO: 48573 - RNA, 14 nt, Homo sapiens
cacagaguuguuac

SEQ ID NO: 48574 - RNA, 20 nt, Homo sapiens
cacagccucuuagaugcagu

SEQ ID NO: 48575 - RNA, 16 nt, Homo sapiens
cacagcugaacuuguu

SEQ ID NO: 48576 - RNA, 12 nt, Homo sapiens
cacaggacagcc

SEQ ID NO: 48577 - RNA, 14 nt, Homo sapiens
cacaggacagcccu

SEQ ID NO: 48578 - RNA, 13 nt, Homo sapiens
cacagugaucaag

SEQ ID NO: 48579 - RNA, 17 nt, Homo sapiens
cacagugaucaaguuau

SEQ ID NO: 48580 - RNA, 12 nt, Homo sapiens
cacagugucugg

SEQ ID NO: 48581 - RNA, 13 nt, Homo sapiens
cacagugucuggc

SEQ ID NO: 48582 - RNA, 13 nt, Homo sapiens
cacaguuuugguu

SEQ ID NO: 48583 - RNA, 21 nt, Homo sapiens
cacaguuuugguugcuuuaau

SEQ ID NO: 48584 - RNA, 17 nt, Homo sapiens
cacauaaggaaacuggg

SEQ ID NO: 48585 - RNA, 21 nt, Homo sapiens
cacaucaaaauaugccccauu

SEQ ID NO: 48586 - RNA, 12 nt, Homo sapiens
cacaucagcuug

SEQ ID NO: 48587 - RNA, 13 nt, Homo sapiens
cacaucagcuugc

SEQ ID NO: 48588 - RNA, 12 nt, Homo sapiens
cacauccugugg

SEQ ID NO: 48589 - RNA, 13 nt, Homo sapiens
cacauccuguggg

SEQ ID NO: 48590 - RNA, 14 nt, Homo sapiens
cacaugauccugca

SEQ ID NO: 48591 - RNA, 15 nt, Homo sapiens
cacaugauccugcaa

SEQ ID NO: 48592 - RNA, 21 nt, Homo sapiens
cacauuccaagccucaugucc

SEQ ID NO: 48593 - RNA, 23 nt, Homo sapiens
cacauuccugaacaggauauucu

SEQ ID NO: 48594 - RNA, 21 nt, Homo sapiens
cacauuuuauuuuauuaugca

SEQ ID NO: 48595 - RNA, 14 nt, Homo sapiens
caccaaacccggcc

SEQ ID NO: 48596 - RNA, 16 nt, Homo sapiens
caccaaacccggccug

SEQ ID NO: 48597 - RNA, 17 nt, Homo sapiens
caccaaacccggccuga

SEQ ID NO: 48598 - RNA, 21 nt, Homo sapiens
caccaaacccggccugauuaa

SEQ ID NO: 48599 - RNA, 13 nt, Homo sapiens
caccacccuugcc

SEQ ID NO: 48600 - RNA, 20 nt, Homo sapiens
caccagagauaauaugagaa

SEQ ID NO: 48601 - RNA, 22 nt, Homo sapiens
caccauauuaccacagacauac

SEQ ID NO: 48602 - RNA, 21 nt, Homo sapiens
caccauuccuucugcccugcu

SEQ ID NO: 48603 - RNA, 20 nt, Homo sapiens
cacccaaaguaucaggacga

SEQ ID NO: 48604 - RNA, 19 nt, Homo sapiens
caccccggacuccuccgca

SEQ ID NO: 48605 - RNA, 15 nt, Homo sapiens
cacccgcccaccgca

SEQ ID NO: 48606 - RNA, 18 nt, Homo sapiens
cacccuugccauggaggu

SEQ ID NO: 48607 - RNA, 22 nt, Homo sapiens
caccgcagggugaacugcagcg

SEQ ID NO: 48608 - RNA, 23 nt, Homo sapiens
caccgcagggugaacugcagcga

SEQ ID NO: 48609 - RNA, 18 nt, Homo sapiens
caccgcuguacgcgagcg

SEQ ID NO: 48610 - RNA, 19 nt, Homo sapiens
caccgcuguacgcgagcgc

SEQ ID NO: 48611 - RNA, 21 nt, Homo sapiens
caccgcuguacgcgagcgcgc

SEQ ID NO: 48612 - RNA, 22 nt, Homo sapiens
caccgcuguacgcgagcgcgcg

SEQ ID NO: 48613 - RNA, 16 nt, Homo sapiens
caccucauggaauugg

SEQ ID NO: 48614 - RNA, 12 nt, Homo sapiens
caccugcaggcg

SEQ ID NO: 48615 - RNA, 21 nt, Homo sapiens
caccugcaggcgugaccugac

SEQ ID NO: 48616 - RNA, 14 nt, Homo sapiens
caccuguaauccca

SEQ ID NO: 48617 - RNA, 15 nt, Homo sapiens
caccugugagaccaa

SEQ ID NO: 48618 - RNA, 14 nt, Homo sapiens
caccugugccgucc

SEQ ID NO: 48619 - RNA, 21 nt, Homo sapiens
caccugugccguccccagagc

SEQ ID NO: 48620 - RNA, 18 nt, Homo sapiens
caccuuacuucuucucau

SEQ ID NO: 48621 - RNA, 15 nt, Homo sapiens
cacgcccagcuaauu

SEQ ID NO: 48622 - RNA, 16 nt, Homo sapiens
cacgccuguaauccca

SEQ ID NO: 48623 - RNA, 20 nt, Homo sapiens
cacgcucugggucgccggca

SEQ ID NO: 48624 - RNA, 22 nt, Homo sapiens
cacgcucugggucgccggcauc

SEQ ID NO: 48625 - RNA, 20 nt, Homo sapiens
cacggacgaaccuugaaaac

SEQ ID NO: 48626 - RNA, 13 nt, Homo sapiens
cacggcuggagcu

SEQ ID NO: 48627 - RNA, 23 nt, Homo sapiens
cacguuucuaaaggcuaccuuug

SEQ ID NO: 48628 - RNA, 18 nt, Homo sapiens
cacuaaaaaggcauguaa

SEQ ID NO: 48629 - RNA, 19 nt, Homo sapiens
cacuaaaaaggcauguaau

SEQ ID NO: 48630 - RNA, 19 nt, Homo sapiens
cacuaaauugacacuuaaa

SEQ ID NO: 48631 - RNA, 14 nt, Homo sapiens
cacuaguauuucua

SEQ ID NO: 48632 - RNA, 15 nt, Homo sapiens
cacuaguauuucuau

SEQ ID NO: 48633 - RNA, 19 nt, Homo sapiens
cacucauuuauuuccauau

SEQ ID NO: 48634 - RNA, 23 nt, Homo sapiens
cacuccaauuaaggauuuuaugc

SEQ ID NO: 48635 - RNA, 22 nt, Homo sapiens
cacuccacuuggacaugggccc

SEQ ID NO: 48636 - RNA, 23 nt, Homo sapiens
cacuccagccugagcgacaguga

SEQ ID NO: 48637 - RNA, 24 nt, Homo sapiens
cacucuauguucuaagaagugaaa

SEQ ID NO: 48638 - RNA, 21 nt, Homo sapiens
cacugaagaagcaccaaucau

SEQ ID NO: 48639 - RNA, 14 nt, Homo sapiens
cacugagcugaggg

SEQ ID NO: 48640 - RNA, 12 nt, Homo sapiens
cacugcauacaa

SEQ ID NO: 48641 - RNA, 13 nt, Homo sapiens
cacugcauacaau

SEQ ID NO: 48642 - RNA, 14 nt, Homo sapiens
cacugcauguuugu

SEQ ID NO: 48643 - RNA, 15 nt, Homo sapiens
cacugccuucucaac

SEQ ID NO: 48644 - RNA, 24 nt, Homo sapiens
cacugcuuaacuucacauauugau

SEQ ID NO: 48645 - RNA, 21 nt, Homo sapiens
cacugguucuucuuggucuca

SEQ ID NO: 48646 - RNA, 22 nt, Homo sapiens
cacugguucuucuuggucucag

SEQ ID NO: 48647 - RNA, 16 nt, Homo sapiens
cacugugggcuuuuau

SEQ ID NO: 48648 - RNA, 22 nt, Homo sapiens
cacuguggguagacacacauga

SEQ ID NO: 48649 - RNA, 23 nt, Homo sapiens
cacuguggguagacacacaugaa

SEQ ID NO: 48650 - RNA, 16 nt, Homo sapiens
cacuguuaucuucacu

SEQ ID NO: 48651 - RNA, 19 nt, Homo sapiens
cacuguuaucuucacuuuu

SEQ ID NO: 48652 - RNA, 14 nt, Homo sapiens
cacuuaaaaauggu

SEQ ID NO: 48653 - RNA, 16 nt, Homo sapiens
cacuuauugacuauua

SEQ ID NO: 48654 - RNA, 18 nt, Homo sapiens
cacuuccucccggccgcg

SEQ ID NO: 48655 - RNA, 22 nt, Homo sapiens
cacuuccucccggccgcgcugc

SEQ ID NO: 48656 - RNA, 17 nt, Homo sapiens
cacuugaacccgggagg

SEQ ID NO: 48657 - RNA, 22 nt, Homo sapiens
cacuuggacaugggccccagau

SEQ ID NO: 48658 - RNA, 20 nt, Homo sapiens
cacuugggacaaaaacaaac

SEQ ID NO: 48659 - RNA, 20 nt, Homo sapiens
cacuugguucuuguacucua

SEQ ID NO: 48660 - RNA, 12 nt, Homo sapiens
cacuugucaaua

SEQ ID NO: 48661 - RNA, 19 nt, Homo sapiens
cacuuguguuuugcaagcc

SEQ ID NO: 48662 - RNA, 19 nt, Homo sapiens
cacuuuaacacagugucug

SEQ ID NO: 48663 - RNA, 21 nt, Homo sapiens
cacuuuaacacagugucuggc

SEQ ID NO: 48664 - RNA, 19 nt, Homo sapiens
cacuuugggaggcugaggc

SEQ ID NO: 48665 - RNA, 22 nt, Homo sapiens
cagaaaacaaggaugaauuaag

SEQ ID NO: 48666 - RNA, 19 nt, Homo sapiens
cagaaaugccuuacccuca

SEQ ID NO: 48667 - RNA, 18 nt, Homo sapiens
cagaaauuuaauucaugu

SEQ ID NO: 48668 - RNA, 19 nt, Homo sapiens
cagaaauuuaauucauguu

SEQ ID NO: 48669 - RNA, 23 nt, Homo sapiens
cagaagaaauucugcaagcuuuu

SEQ ID NO: 48670 - RNA, 13 nt, Homo sapiens
cagaagcaaccca

SEQ ID NO: 48671 - RNA, 18 nt, Homo sapiens
cagaagcuccagguagag

SEQ ID NO: 48672 - RNA, 13 nt, Homo sapiens
cagaagucaaggc

SEQ ID NO: 48673 - RNA, 23 nt, Homo sapiens
cagaagucaaggcuuagacccuc

SEQ ID NO: 48674 - RNA, 22 nt, Homo sapiens
cagacauagaauuaacacauga

SEQ ID NO: 48675 - RNA, 16 nt, Homo sapiens
cagacaucaacagaua

SEQ ID NO: 48676 - RNA, 23 nt, Homo sapiens
cagacaugagagacagcaggucu

SEQ ID NO: 48677 - RNA, 14 nt, Homo sapiens
cagaccgggguucc

SEQ ID NO: 48678 - RNA, 19 nt, Homo sapiens
cagacucuggucaagaagc

SEQ ID NO: 48679 - RNA, 16 nt, Homo sapiens
cagagaaaagacauaa

SEQ ID NO: 48680 - RNA, 21 nt, Homo sapiens
cagagaaaauaaaagcacuua

SEQ ID NO: 48681 - RNA, 19 nt, Homo sapiens
cagagacgggguuugccau

SEQ ID NO: 48682 - RNA, 20 nt, Homo sapiens
cagagcaagacucugucuca

SEQ ID NO: 48683 - RNA, 16 nt, Homo sapiens
cagagcuacaggcccc

SEQ ID NO: 48684 - RNA, 17 nt, Homo sapiens
cagagcuacaggcccca

SEQ ID NO: 48685 - RNA, 12 nt, Homo sapiens
cagagguugcag

SEQ ID NO: 48686 - RNA, 15 nt, Homo sapiens
cagagguugcaguga

SEQ ID NO: 48687 - RNA, 20 nt, Homo sapiens
cagagguugcagugagccga

SEQ ID NO: 48688 - RNA, 17 nt, Homo sapiens
cagaguuguuacauuuu

SEQ ID NO: 48689 - RNA, 17 nt, Homo sapiens
cagauaaacaguaguga

SEQ ID NO: 48690 - RNA, 23 nt, Homo sapiens
cagauaacuguuauuuauaauca

SEQ ID NO: 48691 - RNA, 14 nt, Homo sapiens
cagauaccaugaug

SEQ ID NO: 48692 - RNA, 17 nt, Homo sapiens
cagauaccaugaugcug

SEQ ID NO: 48693 - RNA, 17 nt, Homo sapiens
cagaucaagccugccuc

SEQ ID NO: 48694 - RNA, 20 nt, Homo sapiens
cagaucauuucaaaacucau

SEQ ID NO: 48695 - RNA, 15 nt, Homo sapiens
cagaucucuaacuuc

SEQ ID NO: 48696 - RNA, 19 nt, Homo sapiens
cagcaauaaagcagcguuu

SEQ ID NO: 48697 - RNA, 14 nt, Homo sapiens
cagcacagccucuu

SEQ ID NO: 48698 - RNA, 22 nt, Homo sapiens
cagcacagccucuuagaugcag

SEQ ID NO: 48699 - RNA, 15 nt, Homo sapiens
cagcaccuacagugu

SEQ ID NO: 48700 - RNA, 12 nt, Homo sapiens
cagcagagaagu

SEQ ID NO: 48701 - RNA, 13 nt, Homo sapiens
cagcagagaaguu

SEQ ID NO: 48702 - RNA, 15 nt, Homo sapiens
cagcagagacggggu

SEQ ID NO: 48703 - RNA, 22 nt, Homo sapiens
cagcaggauagagugggacagu

SEQ ID NO: 48704 - RNA, 15 nt, Homo sapiens
cagcauuuuacuacu

SEQ ID NO: 48705 - RNA, 16 nt, Homo sapiens
cagcauuuuacuacuu

SEQ ID NO: 48706 - RNA, 14 nt, Homo sapiens
cagccagacuggca

SEQ ID NO: 48707 - RNA, 14 nt, Homo sapiens
cagccaggcggcug

SEQ ID NO: 48708 - RNA, 15 nt, Homo sapiens
cagccaggcggcugg

SEQ ID NO: 48709 - RNA, 17 nt, Homo sapiens
cagccaggcggcuggaa

SEQ ID NO: 48710 - RNA, 21 nt, Homo sapiens
cagccaggcggcuggaauuga

SEQ ID NO: 48711 - RNA, 22 nt, Homo sapiens
cagccaggcggcuggaauugaa

SEQ ID NO: 48712 - RNA, 20 nt, Homo sapiens
cagcccccauuguggucaca

SEQ ID NO: 48713 - RNA, 15 nt, Homo sapiens
cagccccgggagugg

SEQ ID NO: 48714 - RNA, 18 nt, Homo sapiens
cagccccuugagaaaccu

SEQ ID NO: 48715 - RNA, 11 nt, Homo sapiens
cagcccuacac

SEQ ID NO: 48716 - RNA, 12 nt, Homo sapiens
cagcccuacacc

SEQ ID NO: 48717 - RNA, 21 nt, Homo sapiens
cagcccucuucugacacuaaa

SEQ ID NO: 48718 - RNA, 15 nt, Homo sapiens
cagccuaguugauca

SEQ ID NO: 48719 - RNA, 15 nt, Homo sapiens
cagccucagcucuca

SEQ ID NO: 48720 - RNA, 22 nt, Homo sapiens
cagccucagcucucaguugcag

SEQ ID NO: 48721 - RNA, 19 nt, Homo sapiens
cagccucuuagaugcaguu

SEQ ID NO: 48722 - RNA, 18 nt, Homo sapiens
cagccugaaagaggaaug

SEQ ID NO: 48723 - RNA, 13 nt, Homo sapiens
cagccugggugac

SEQ ID NO: 48724 - RNA, 16 nt, Homo sapiens
cagccugggugacaga

SEQ ID NO: 48725 - RNA, 22 nt, Homo sapiens
cagccuggucaacauggugaaa

SEQ ID NO: 48726 - RNA, 17 nt, Homo sapiens
cagccuuggauacucca

SEQ ID NO: 48727 - RNA, 15 nt, Homo sapiens
cagcgaguacuuccc

SEQ ID NO: 48728 - RNA, 19 nt, Homo sapiens
cagcgaguacuucccgcug

SEQ ID NO: 48729 - RNA, 19 nt, Homo sapiens
cagcguuucuaugacacau

SEQ ID NO: 48730 - RNA, 14 nt, Homo sapiens
cagcuacaauugua

SEQ ID NO: 48731 - RNA, 15 nt, Homo sapiens
cagcuacaauuguaa

SEQ ID NO: 48732 - RNA, 17 nt, Homo sapiens
cagcuacuugggaggcu

SEQ ID NO: 48733 - RNA, 18 nt, Homo sapiens
cagcuacuugggaggcug

SEQ ID NO: 48734 - RNA, 19 nt, Homo sapiens
cagcuacuugggaggcuga

SEQ ID NO: 48735 - RNA, 22 nt, Homo sapiens
cagcuacuugggaggcugagau

SEQ ID NO: 48736 - RNA, 14 nt, Homo sapiens
cagcucaggcuggc

SEQ ID NO: 48737 - RNA, 16 nt, Homo sapiens
cagcucaggcuggcac

SEQ ID NO: 48738 - RNA, 19 nt, Homo sapiens
cagcucaggcuggcaccgc

SEQ ID NO: 48739 - RNA, 20 nt, Homo sapiens
cagcucaggcuggcaccgcu

SEQ ID NO: 48740 - RNA, 18 nt, Homo sapiens
cagcucuaaaugucaauc

SEQ ID NO: 48741 - RNA, 19 nt, Homo sapiens
cagcucuaaaugucaauca

SEQ ID NO: 48742 - RNA, 23 nt, Homo sapiens
cagcucucaguugcagcccugcu

SEQ ID NO: 48743 - RNA, 15 nt, Homo sapiens
cagcugcagaggcca

SEQ ID NO: 48744 - RNA, 12 nt, Homo sapiens
cagcugccccgg

SEQ ID NO: 48745 - RNA, 13 nt, Homo sapiens
cagcugccccggg

SEQ ID NO: 48746 - RNA, 22 nt, Homo sapiens
cagcugccccggggaggggcgc

SEQ ID NO: 48747 - RNA, 13 nt, Homo sapiens
cagcuguuuaugc

SEQ ID NO: 48748 - RNA, 20 nt, Homo sapiens
cagcuguuuaugcauagaua

SEQ ID NO: 48749 - RNA, 13 nt, Homo sapiens
cagcuuauucaca

SEQ ID NO: 48750 - RNA, 14 nt, Homo sapiens
cagcuugaaacuga

SEQ ID NO: 48751 - RNA, 11 nt, Homo sapiens
caggaaaauaa

SEQ ID NO: 48752 - RNA, 12 nt, Homo sapiens
caggaaaauuaa

SEQ ID NO: 48753 - RNA, 24 nt, Homo sapiens
caggaaagagaacuuccagauccu

SEQ ID NO: 48754 - RNA, 14 nt, Homo sapiens
caggaaaucaaaua

SEQ ID NO: 48755 - RNA, 19 nt, Homo sapiens
caggaaaucaaauaugcaa

SEQ ID NO: 48756 - RNA, 17 nt, Homo sapiens
caggaaccacaagacug

SEQ ID NO: 48757 - RNA, 16 nt, Homo sapiens
caggaccaucccggcc

SEQ ID NO: 48758 - RNA, 17 nt, Homo sapiens
caggaccaucccggccg

SEQ ID NO: 48759 - RNA, 18 nt, Homo sapiens
caggaccaucccggccgg

SEQ ID NO: 48760 - RNA, 19 nt, Homo sapiens
caggaccaucccggccggc

SEQ ID NO: 48761 - RNA, 20 nt, Homo sapiens
caggaccaucccggccggcg

SEQ ID NO: 48762 - RNA, 21 nt, Homo sapiens
caggaccaucccggccggcgc

SEQ ID NO: 48763 - RNA, 24 nt, Homo sapiens
caggaccaucccggccggcgcgcu

SEQ ID NO: 48764 - RNA, 16 nt, Homo sapiens
caggaguuccuaacca

SEQ ID NO: 48765 - RNA, 22 nt, Homo sapiens
caggaguuccuaaccagccugg

SEQ ID NO: 48766 - RNA, 17 nt, Homo sapiens
caggaguuuggccagaa

SEQ ID NO: 48767 - RNA, 17 nt, Homo sapiens
caggauaagagggauua

SEQ ID NO: 48768 - RNA, 14 nt, Homo sapiens
caggauagaguggg

SEQ ID NO: 48769 - RNA, 18 nt, Homo sapiens
caggauagagugggacag

SEQ ID NO: 48770 - RNA, 19 nt, Homo sapiens
caggauagagugggacagu

SEQ ID NO: 48771 - RNA, 22 nt, Homo sapiens
caggauagagugggacaguucc

SEQ ID NO: 48772 - RNA, 14 nt, Homo sapiens
caggaugcccacgg

SEQ ID NO: 48773 - RNA, 17 nt, Homo sapiens
caggauuuaaguuucac

SEQ ID NO: 48774 - RNA, 19 nt, Homo sapiens
caggauuuuaaucuuuuuc

SEQ ID NO: 48775 - RNA, 12 nt, Homo sapiens
caggcagcagga

SEQ ID NO: 48776 - RNA, 14 nt, Homo sapiens
caggcagcaggaua

SEQ ID NO: 48777 - RNA, 15 nt, Homo sapiens
caggcagcaggauag

SEQ ID NO: 48778 - RNA, 14 nt, Homo sapiens
caggccccaucugg

SEQ ID NO: 48779 - RNA, 16 nt, Homo sapiens
caggccccaucugguc

SEQ ID NO: 48780 - RNA, 18 nt, Homo sapiens
caggcggguccgggucgc

SEQ ID NO: 48781 - RNA, 19 nt, Homo sapiens
caggcggguccgggucgca

SEQ ID NO: 48782 - RNA, 18 nt, Homo sapiens
caggcgugaccugacagc

SEQ ID NO: 48783 - RNA, 21 nt, Homo sapiens
caggcgugaccugacagccca

SEQ ID NO: 48784 - RNA, 22 nt, Homo sapiens
caggcgugaccugacagcccaa

SEQ ID NO: 48785 - RNA, 19 nt, Homo sapiens
caggcgugagccaccaaac

SEQ ID NO: 48786 - RNA, 22 nt, Homo sapiens
caggcgugagccaccaaacccg

SEQ ID NO: 48787 - RNA, 14 nt, Homo sapiens
caggcuagauguau

SEQ ID NO: 48788 - RNA, 16 nt, Homo sapiens
caggcucaacauaaca

SEQ ID NO: 48789 - RNA, 16 nt, Homo sapiens
caggcuccaaacugga

SEQ ID NO: 48790 - RNA, 21 nt, Homo sapiens
caggcuccaaacuggagcuug

SEQ ID NO: 48791 - RNA, 16 nt, Homo sapiens
caggcuggcaccgcug

SEQ ID NO: 48792 - RNA, 17 nt, Homo sapiens
caggcuggcaccgcugu

SEQ ID NO: 48793 - RNA, 19 nt, Homo sapiens
caggcuggcaccgcuguac

SEQ ID NO: 48794 - RNA, 11 nt, Homo sapiens
caggcuggcca

SEQ ID NO: 48795 - RNA, 23 nt, Homo sapiens
caggcuggucucgaacugcugga

SEQ ID NO: 48796 - RNA, 23 nt, Homo sapiens
cagggaaauguaugugugucuau

SEQ ID NO: 48797 - RNA, 13 nt, Homo sapiens
cagggacuugaac

SEQ ID NO: 48798 - RNA, 14 nt, Homo sapiens
cagggccuggcugg

SEQ ID NO: 48799 - RNA, 13 nt, Homo sapiens
cagggcuacgcgc

SEQ ID NO: 48800 - RNA, 14 nt, Homo sapiens
cagggcuacgcgcg

SEQ ID NO: 48801 - RNA, 15 nt, Homo sapiens
cagggcuacgcgcgc

SEQ ID NO: 48802 - RNA, 17 nt, Homo sapiens
cagggcuacgcgcgcuc

SEQ ID NO: 48803 - RNA, 18 nt, Homo sapiens
cagggcuacgcgcgcucc

SEQ ID NO: 48804 - RNA, 19 nt, Homo sapiens
cagggcuacgcgcgcuccg

SEQ ID NO: 48805 - RNA, 21 nt, Homo sapiens
cagggcuacgcgcgcuccgcg

SEQ ID NO: 48806 - RNA, 22 nt, Homo sapiens
cagggcuacgcgcgcuccgcgc

SEQ ID NO: 48807 - RNA, 16 nt, Homo sapiens
cagggugaacugcagc

SEQ ID NO: 48808 - RNA, 20 nt, Homo sapiens
cagggugaacugcagcgagu

SEQ ID NO: 48809 - RNA, 14 nt, Homo sapiens
cagguaccuucuca

SEQ ID NO: 48810 - RNA, 22 nt, Homo sapiens
cagguaccuucucaccugugag

SEQ ID NO: 48811 - RNA, 20 nt, Homo sapiens
caggugacccugaugaaaac

SEQ ID NO: 48812 - RNA, 13 nt, Homo sapiens
cagguguccgcua

SEQ ID NO: 48813 - RNA, 10 nt, Homo sapiens
caguaacuga

SEQ ID NO: 48814 - RNA, 21 nt, Homo sapiens
caguaauuuuaaguaauuuca

SEQ ID NO: 48815 - RNA, 16 nt, Homo sapiens
caguaguuagcuuucu

SEQ ID NO: 48816 - RNA, 18 nt, Homo sapiens
caguaguuagcuuucuuc

SEQ ID NO: 48817 - RNA, 14 nt, Homo sapiens
cagucacauuccaa

SEQ ID NO: 48818 - RNA, 15 nt, Homo sapiens
cagucacauuccaag

SEQ ID NO: 48819 - RNA, 15 nt, Homo sapiens
cagucaccucaugga

SEQ ID NO: 48820 - RNA, 14 nt, Homo sapiens
cagucagaagaccu

SEQ ID NO: 48821 - RNA, 19 nt, Homo sapiens
cagucauucagauaugauu

SEQ ID NO: 48822 - RNA, 14 nt, Homo sapiens
caguccucuuucaa

SEQ ID NO: 48823 - RNA, 20 nt, Homo sapiens
cagugagacucugucucagu

SEQ ID NO: 48824 - RNA, 16 nt, Homo sapiens
cagugagaucaaugug

SEQ ID NO: 48825 - RNA, 12 nt, Homo sapiens
cagugagccgag

SEQ ID NO: 48826 - RNA, 19 nt, Homo sapiens
cagugagccgagauugugc

SEQ ID NO: 48827 - RNA, 20 nt, Homo sapiens
cagugagcugauaucaugcc

SEQ ID NO: 48828 - RNA, 19 nt, Homo sapiens
cagugauuaccagggacug

SEQ ID NO: 48829 - RNA, 14 nt, Homo sapiens
cagugcuuggccca

SEQ ID NO: 48830 - RNA, 15 nt, Homo sapiens
cagugcuuggcccag

SEQ ID NO: 48831 - RNA, 16 nt, Homo sapiens
cagugcuuggcccagg

SEQ ID NO: 48832 - RNA, 20 nt, Homo sapiens
cagugcuuggcccaggaguu

SEQ ID NO: 48833 - RNA, 15 nt, Homo sapiens
cagugcuuuaauggc

SEQ ID NO: 48834 - RNA, 16 nt, Homo sapiens
caguggcgcaaucuua

SEQ ID NO: 48835 - RNA, 17 nt, Homo sapiens
caguggcgcaaucuuaa

SEQ ID NO: 48836 - RNA, 18 nt, Homo sapiens
cagugucaaugcagcccc

SEQ ID NO: 48837 - RNA, 13 nt, Homo sapiens
caguguccucauc

SEQ ID NO: 48838 - RNA, 13 nt, Homo sapiens
cagugucuggcac

SEQ ID NO: 48839 - RNA, 18 nt, Homo sapiens
cagugucuggcacuuggg

SEQ ID NO: 48840 - RNA, 19 nt, Homo sapiens
cagugucuggcacuuggga

SEQ ID NO: 48841 - RNA, 16 nt, Homo sapiens
caguucugaagaagau

SEQ ID NO: 48842 - RNA, 19 nt, Homo sapiens
caguuguuauuuauugaaa

SEQ ID NO: 48843 - RNA, 19 nt, Homo sapiens
caguuuuccuucucaucug

SEQ ID NO: 48844 - RNA, 18 nt, Homo sapiens
caguuuucugagaaagac

SEQ ID NO: 48845 - RNA, 15 nt, Homo sapiens
caguuuuuauauaga

SEQ ID NO: 48846 - RNA, 19 nt, Homo sapiens
cauaaacaagaccacguuu

SEQ ID NO: 48847 - RNA, 16 nt, Homo sapiens
cauaaaguaugugcau

SEQ ID NO: 48848 - RNA, 17 nt, Homo sapiens
cauaaaguaugugcaua

SEQ ID NO: 48849 - RNA, 15 nt, Homo sapiens
cauaaagucagugcc

SEQ ID NO: 48850 - RNA, 19 nt, Homo sapiens
cauaaccccggaagccaaa

SEQ ID NO: 48851 - RNA, 15 nt, Homo sapiens
cauaagaauucuguu

SEQ ID NO: 48852 - RNA, 15 nt, Homo sapiens
cauaaugcgugcaua

SEQ ID NO: 48853 - RNA, 23 nt, Homo sapiens
cauacaauuauuuuuacaguucu

SEQ ID NO: 48854 - RNA, 21 nt, Homo sapiens
cauacacaccccggacuccuc

SEQ ID NO: 48855 - RNA, 23 nt, Homo sapiens
cauacacaccccggacuccuccg

SEQ ID NO: 48856 - RNA, 12 nt, Homo sapiens
cauaccacuuuu

SEQ ID NO: 48857 - RNA, 16 nt, Homo sapiens
cauacguacacauuuu

SEQ ID NO: 48858 - RNA, 10 nt, Homo sapiens
cauacugcug

SEQ ID NO: 48859 - RNA, 23 nt, Homo sapiens
cauacuucuuaggguuaugauua

SEQ ID NO: 48860 - RNA, 13 nt, Homo sapiens
cauagaauagugu

SEQ ID NO: 48861 - RNA, 14 nt, Homo sapiens
cauagaauaguguu

SEQ ID NO: 48862 - RNA, 17 nt, Homo sapiens
cauagaauuaacacaug

SEQ ID NO: 48863 - RNA, 22 nt, Homo sapiens
cauagagaauauaaaaauaaag

SEQ ID NO: 48864 - RNA, 19 nt, Homo sapiens
cauagauucccugagcagg

SEQ ID NO: 48865 - RNA, 12 nt, Homo sapiens
cauagcagcuua

SEQ ID NO: 48866 - RNA, 18 nt, Homo sapiens
cauagcagcuuauucaca

SEQ ID NO: 48867 - RNA, 18 nt, Homo sapiens
cauagcaucucaggagau

SEQ ID NO: 48868 - RNA, 12 nt, Homo sapiens
cauagggugaca

SEQ ID NO: 48869 - RNA, 13 nt, Homo sapiens
cauagggugacac

SEQ ID NO: 48870 - RNA, 19 nt, Homo sapiens
cauaguaccucugcuauuu

SEQ ID NO: 48871 - RNA, 14 nt, Homo sapiens
cauauauaacaaug

SEQ ID NO: 48872 - RNA, 18 nt, Homo sapiens
cauaucacaugucagcca

SEQ ID NO: 48873 - RNA, 21 nt, Homo sapiens
cauauuaccacagacauacua

SEQ ID NO: 48874 - RNA, 23 nt, Homo sapiens
cauauuuaacaaaauuugaauag

SEQ ID NO: 48875 - RNA, 15 nt, Homo sapiens
cauauuuucaugcug

SEQ ID NO: 48876 - RNA, 20 nt, Homo sapiens
caucaaggguacacugccuu

SEQ ID NO: 48877 - RNA, 19 nt, Homo sapiens
caucaaugaaugaaugaau

SEQ ID NO: 48878 - RNA, 21 nt, Homo sapiens
caucaaugauaaugcuaauuu

SEQ ID NO: 48879 - RNA, 20 nt, Homo sapiens
caucaauuuuaguugucaau

SEQ ID NO: 48880 - RNA, 21 nt, Homo sapiens
caucacagcugaacuuguuga

SEQ ID NO: 48881 - RNA, 19 nt, Homo sapiens
caucagcacgauuucuguu

SEQ ID NO: 48882 - RNA, 20 nt, Homo sapiens
caucagcugcugaaacaaca

SEQ ID NO: 48883 - RNA, 20 nt, Homo sapiens
caucagcuugcccuguuaaa

SEQ ID NO: 48884 - RNA, 10 nt, Homo sapiens
cauccaaagg

SEQ ID NO: 48885 - RNA, 17 nt, Homo sapiens
cauccaaaggcuccuga

SEQ ID NO: 48886 - RNA, 19 nt, Homo sapiens
cauccagauacacccaaag

SEQ ID NO: 48887 - RNA, 18 nt, Homo sapiens
cauccauggugugcuggc

SEQ ID NO: 48888 - RNA, 12 nt, Homo sapiens
caucccacccgc

SEQ ID NO: 48889 - RNA, 15 nt, Homo sapiens
caucccacccgccca

SEQ ID NO: 48890 - RNA, 16 nt, Homo sapiens
caucccacccgcccac

SEQ ID NO: 48891 - RNA, 17 nt, Homo sapiens
caucccacccgcccacc

SEQ ID NO: 48892 - RNA, 12 nt, Homo sapiens
caucccggccgg

SEQ ID NO: 48893 - RNA, 13 nt, Homo sapiens
caucccggccggc

SEQ ID NO: 48894 - RNA, 14 nt, Homo sapiens
caucccggccggcg

SEQ ID NO: 48895 - RNA, 15 nt, Homo sapiens
caucccggccggcgc

SEQ ID NO: 48896 - RNA, 16 nt, Homo sapiens
caucccggccggcgcg

SEQ ID NO: 48897 - RNA, 17 nt, Homo sapiens
caucccggccggcgcgc

SEQ ID NO: 48898 - RNA, 20 nt, Homo sapiens
caucccggccggcgcgcuca

SEQ ID NO: 48899 - RNA, 17 nt, Homo sapiens
cauccuggaauaucucc

SEQ ID NO: 48900 - RNA, 13 nt, Homo sapiens
caucgccauucuu

SEQ ID NO: 48901 - RNA, 18 nt, Homo sapiens
caucgcuuaggagaaguc

SEQ ID NO: 48902 - RNA, 13 nt, Homo sapiens
caucucugcaauc

SEQ ID NO: 48903 - RNA, 14 nt, Homo sapiens
caucuuggucacau

SEQ ID NO: 48904 - RNA, 17 nt, Homo sapiens
caucuuggucacauaca

SEQ ID NO: 48905 - RNA, 18 nt, Homo sapiens
caucuuggucacauacaa

SEQ ID NO: 48906 - RNA, 12 nt, Homo sapiens
caucuuucaagg

SEQ ID NO: 48907 - RNA, 13 nt, Homo sapiens
caucuuucacauu

SEQ ID NO: 48908 - RNA, 14 nt, Homo sapiens
caugaaaagauuau

SEQ ID NO: 48909 - RNA, 13 nt, Homo sapiens
caugaaggggcgg

SEQ ID NO: 48910 - RNA, 14 nt, Homo sapiens
caugaaggggcggc

SEQ ID NO: 48911 - RNA, 15 nt, Homo sapiens
caugaaggggcggcg

SEQ ID NO: 48912 - RNA, 16 nt, Homo sapiens
caugaaguccaagcau

SEQ ID NO: 48913 - RNA, 17 nt, Homo sapiens
caugaaguccaagcauu

SEQ ID NO: 48914 - RNA, 18 nt, Homo sapiens
caugaaguccaagcauuu

SEQ ID NO: 48915 - RNA, 16 nt, Homo sapiens
caugaauaucaguuau

SEQ ID NO: 48916 - RNA, 17 nt, Homo sapiens
caugagagacagcaggu

SEQ ID NO: 48917 - RNA, 19 nt, Homo sapiens
caugagguacugagaguga

SEQ ID NO: 48918 - RNA, 18 nt, Homo sapiens
caugaucccaccucccau

SEQ ID NO: 48919 - RNA, 21 nt, Homo sapiens
caugaucccaccucccauuca

SEQ ID NO: 48920 - RNA, 22 nt, Homo sapiens
caugaucccaccucccauucac

SEQ ID NO: 48921 - RNA, 12 nt, Homo sapiens
caugaugcugag

SEQ ID NO: 48922 - RNA, 18 nt, Homo sapiens
caugaugcugagcccgga

SEQ ID NO: 48923 - RNA, 16 nt, Homo sapiens
caugcuacacacugca

SEQ ID NO: 48924 - RNA, 12 nt, Homo sapiens
caugcucuccaa

SEQ ID NO: 48925 - RNA, 22 nt, Homo sapiens
caugcucuccaaaccacuuuuu

SEQ ID NO: 48926 - RNA, 16 nt, Homo sapiens
caugcugccaauaucc

SEQ ID NO: 48927 - RNA, 16 nt, Homo sapiens
caugcuggccaggcug

SEQ ID NO: 48928 - RNA, 17 nt, Homo sapiens
caugcuggccaggcugg

SEQ ID NO: 48929 - RNA, 21 nt, Homo sapiens
caugcuggccaggcuggucuc

SEQ ID NO: 48930 - RNA, 12 nt, Homo sapiens
cauggaauugga

SEQ ID NO: 48931 - RNA, 13 nt, Homo sapiens
cauggaauuggag

SEQ ID NO: 48932 - RNA, 17 nt, Homo sapiens
cauggaauuggagcucg

SEQ ID NO: 48933 - RNA, 18 nt, Homo sapiens
cauggaauuggagcucgu

SEQ ID NO: 48934 - RNA, 20 nt, Homo sapiens
cauggaauuggagcucgugg

SEQ ID NO: 48935 - RNA, 17 nt, Homo sapiens
cauggcaggcaucgcca

SEQ ID NO: 48936 - RNA, 22 nt, Homo sapiens
caugggccuagcccacuggcuc

SEQ ID NO: 48937 - RNA, 23 nt, Homo sapiens
cauggggguaauaagagcaguag

SEQ ID NO: 48938 - RNA, 19 nt, Homo sapiens
cauguaugacgugacuggc

SEQ ID NO: 48939 - RNA, 20 nt, Homo sapiens
cauguaugacgugacuggcc

SEQ ID NO: 48940 - RNA, 16 nt, Homo sapiens
caugucagccacugug

SEQ ID NO: 48941 - RNA, 18 nt, Homo sapiens
caugucagccacugugau

SEQ ID NO: 48942 - RNA, 20 nt, Homo sapiens
caugugauuacccucugggu

SEQ ID NO: 48943 - RNA, 18 nt, Homo sapiens
caugugcuaguaauugga

SEQ ID NO: 48944 - RNA, 19 nt, Homo sapiens
caugugcuaguaauuggaa

SEQ ID NO: 48945 - RNA, 20 nt, Homo sapiens
caugugcuaguaauuggaaa

SEQ ID NO: 48946 - RNA, 14 nt, Homo sapiens
cauguucuuaauuc

SEQ ID NO: 48947 - RNA, 10 nt, Homo sapiens
cauguuucuu

SEQ ID NO: 48948 - RNA, 19 nt, Homo sapiens
cauguuuucuuugcuuuaa

SEQ ID NO: 48949 - RNA, 14 nt, Homo sapiens
cauuaaaguucuag

SEQ ID NO: 48950 - RNA, 15 nt, Homo sapiens
cauuaaaguucuagu

SEQ ID NO: 48951 - RNA, 22 nt, Homo sapiens
cauuaaauggaaguaaauguug

SEQ ID NO: 48952 - RNA, 13 nt, Homo sapiens
cauuaauguagau

SEQ ID NO: 48953 - RNA, 13 nt, Homo sapiens
cauuaguuuugaa

SEQ ID NO: 48954 - RNA, 12 nt, Homo sapiens
cauuauauuuau

SEQ ID NO: 48955 - RNA, 14 nt, Homo sapiens
cauuauauuuauua

SEQ ID NO: 48956 - RNA, 24 nt, Homo sapiens
cauuauauuuauuacuguaagaaa

SEQ ID NO: 48957 - RNA, 13 nt, Homo sapiens
cauuaucagucca

SEQ ID NO: 48958 - RNA, 19 nt, Homo sapiens
cauuaucuagauacuguau

SEQ ID NO: 48959 - RNA, 15 nt, Homo sapiens
cauuauuuauauggg

SEQ ID NO: 48960 - RNA, 15 nt, Homo sapiens
cauucaggaugccca

SEQ ID NO: 48961 - RNA, 21 nt, Homo sapiens
cauucaggaugcccacggcug

SEQ ID NO: 48962 - RNA, 22 nt, Homo sapiens
cauucaggaugcccacggcugg

SEQ ID NO: 48963 - RNA, 12 nt, Homo sapiens
cauuccauuugc

SEQ ID NO: 48964 - RNA, 13 nt, Homo sapiens
cauuccauuugcu

SEQ ID NO: 48965 - RNA, 14 nt, Homo sapiens
cauuccauuugcug

SEQ ID NO: 48966 - RNA, 19 nt, Homo sapiens
cauucuccuuguguuacua

SEQ ID NO: 48967 - RNA, 13 nt, Homo sapiens
cauucugccugcc

SEQ ID NO: 48968 - RNA, 14 nt, Homo sapiens
cauucugccugccc

SEQ ID NO: 48969 - RNA, 14 nt, Homo sapiens
cauucuuuuugaaa

SEQ ID NO: 48970 - RNA, 18 nt, Homo sapiens
cauucuuuuugaaauguc

SEQ ID NO: 48971 - RNA, 15 nt, Homo sapiens
cauugcaaccuccac

SEQ ID NO: 48972 - RNA, 16 nt, Homo sapiens
cauugcaaccuccacc

SEQ ID NO: 48973 - RNA, 18 nt, Homo sapiens
cauuggaaacaagucagu

SEQ ID NO: 48974 - RNA, 18 nt, Homo sapiens
cauuguaauugcuaucgc

SEQ ID NO: 48975 - RNA, 21 nt, Homo sapiens
cauuguucuugugaacccaaa

SEQ ID NO: 48976 - RNA, 16 nt, Homo sapiens
cauuuaauccucucaa

SEQ ID NO: 48977 - RNA, 22 nt, Homo sapiens
cauuucaaaagguauuuauuga

SEQ ID NO: 48978 - RNA, 16 nt, Homo sapiens
cauuuccaaauucaca

SEQ ID NO: 48979 - RNA, 18 nt, Homo sapiens
cauuuccaagcaaguauu

SEQ ID NO: 48980 - RNA, 16 nt, Homo sapiens
cauuucucauguugaa

SEQ ID NO: 48981 - RNA, 17 nt, Homo sapiens
cauuucucauguugaaa

SEQ ID NO: 48982 - RNA, 16 nt, Homo sapiens
cauuucugcaucagcu

SEQ ID NO: 48983 - RNA, 22 nt, Homo sapiens
cauuugagcucuggaagccucu

SEQ ID NO: 48984 - RNA, 13 nt, Homo sapiens
cauuugcacuauu

SEQ ID NO: 48985 - RNA, 14 nt, Homo sapiens
cauuugcucaugga

SEQ ID NO: 48986 - RNA, 15 nt, Homo sapiens
cauuugcucauggaa

SEQ ID NO: 48987 - RNA, 10 nt, Homo sapiens
cauuugguaa

SEQ ID NO: 48988 - RNA, 15 nt, Homo sapiens
cauuuguauaaaaua

SEQ ID NO: 48989 - RNA, 18 nt, Homo sapiens
cauuuguuaauauuucuu

SEQ ID NO: 48990 - RNA, 18 nt, Homo sapiens
cauuuuaaaaaauggaac

SEQ ID NO: 48991 - RNA, 14 nt, Homo sapiens
cauuuuaugucuuu

SEQ ID NO: 48992 - RNA, 21 nt, Homo sapiens
cauuuuauuuuauuaugcaug

SEQ ID NO: 48993 - RNA, 22 nt, Homo sapiens
cauuuuauuuuauuaugcauga

SEQ ID NO: 48994 - RNA, 13 nt, Homo sapiens
cauuuucacuuuu

SEQ ID NO: 48995 - RNA, 14 nt, Homo sapiens
cauuuuuacuuggg

SEQ ID NO: 48996 - RNA, 15 nt, Homo sapiens
cauuuuuacuugggu

SEQ ID NO: 48997 - RNA, 16 nt, Homo sapiens
cauuuuugaaaccaaa

SEQ ID NO: 48998 - RNA, 21 nt, Homo sapiens
ccaaaagguauuuuaaucacc

SEQ ID NO: 48999 - RNA, 18 nt, Homo sapiens
ccaaaaucggaucugggg

SEQ ID NO: 49000 - RNA, 17 nt, Homo sapiens
ccaaacagaacuaugga

SEQ ID NO: 49001 - RNA, 22 nt, Homo sapiens
ccaaaccagagccugaguguug

SEQ ID NO: 49002 - RNA, 12 nt, Homo sapiens
ccaaacuggagc

SEQ ID NO: 49003 - RNA, 19 nt, Homo sapiens
ccaaagaaauguaagggaa

SEQ ID NO: 49004 - RNA, 19 nt, Homo sapiens
ccaaagcccaaagugguau

SEQ ID NO: 49005 - RNA, 20 nt, Homo sapiens
ccaaaguaucaggacgagaa

SEQ ID NO: 49006 - RNA, 14 nt, Homo sapiens
ccaaagugguauag

SEQ ID NO: 49007 - RNA, 13 nt, Homo sapiens
ccaaauucacaag

SEQ ID NO: 49008 - RNA, 19 nt, Homo sapiens
ccaaauuucauaccuauca

SEQ ID NO: 49009 - RNA, 15 nt, Homo sapiens
ccaacacgagcaggc

SEQ ID NO: 49010 - RNA, 12 nt, Homo sapiens
ccaacuaggcag

SEQ ID NO: 49011 - RNA, 21 nt, Homo sapiens
ccaacuaucucauuuccaagc

SEQ ID NO: 49012 - RNA, 15 nt, Homo sapiens
ccaagaaauauuccu

SEQ ID NO: 49013 - RNA, 18 nt, Homo sapiens
ccaagaaugagaagaaug

SEQ ID NO: 49014 - RNA, 18 nt, Homo sapiens
ccaagcaaauggccaaug

SEQ ID NO: 49015 - RNA, 13 nt, Homo sapiens
ccaagcaaguauu

SEQ ID NO: 49016 - RNA, 14 nt, Homo sapiens
ccaagcaaguauua

SEQ ID NO: 49017 - RNA, 20 nt, Homo sapiens
ccaagcauuuagauguauag

SEQ ID NO: 49018 - RNA, 14 nt, Homo sapiens
ccaaggcccccggg

SEQ ID NO: 49019 - RNA, 15 nt, Homo sapiens
ccaaggcccccgggc

SEQ ID NO: 49020 - RNA, 16 nt, Homo sapiens
ccaaggcccccgggcc

SEQ ID NO: 49021 - RNA, 18 nt, Homo sapiens
ccaaggcccccgggccga

SEQ ID NO: 49022 - RNA, 20 nt, Homo sapiens
ccaaggcccccgggccgacg

SEQ ID NO: 49023 - RNA, 14 nt, Homo sapiens
ccaaguuuauauac

SEQ ID NO: 49024 - RNA, 17 nt, Homo sapiens
ccaauaaagaguuccuu

SEQ ID NO: 49025 - RNA, 18 nt, Homo sapiens
ccaauaaagaguuccuuc

SEQ ID NO: 49026 - RNA, 12 nt, Homo sapiens
ccaauacauuau

SEQ ID NO: 49027 - RNA, 19 nt, Homo sapiens
ccaaugagaucauugugaa

SEQ ID NO: 49028 - RNA, 19 nt, Homo sapiens
ccacaaaauugggaaagga

SEQ ID NO: 49029 - RNA, 21 nt, Homo sapiens
ccacaacuauauuaucaugca

SEQ ID NO: 49030 - RNA, 19 nt, Homo sapiens
ccacaccagggccuggcug

SEQ ID NO: 49031 - RNA, 18 nt, Homo sapiens
ccacagcuguaugauucc

SEQ ID NO: 49032 - RNA, 19 nt, Homo sapiens
ccacagcuguaugauuccc

SEQ ID NO: 49033 - RNA, 14 nt, Homo sapiens
ccacaggaaccaca

SEQ ID NO: 49034 - RNA, 14 nt, Homo sapiens
ccacauggcuucac

SEQ ID NO: 49035 - RNA, 14 nt, Homo sapiens
ccaccaaacccggc

SEQ ID NO: 49036 - RNA, 15 nt, Homo sapiens
ccaccaaacccggcc

SEQ ID NO: 49037 - RNA, 15 nt, Homo sapiens
ccaccacgcccagcu

SEQ ID NO: 49038 - RNA, 21 nt, Homo sapiens
ccaccagucugacuguuucca

SEQ ID NO: 49039 - RNA, 12 nt, Homo sapiens
ccacccgcccac

SEQ ID NO: 49040 - RNA, 13 nt, Homo sapiens
ccacccgcccacc

SEQ ID NO: 49041 - RNA, 14 nt, Homo sapiens
ccacccgcccaccg

SEQ ID NO: 49042 - RNA, 16 nt, Homo sapiens
ccaccuucuggguuca

SEQ ID NO: 49043 - RNA, 16 nt, Homo sapiens
ccacgcccagcuaauu

SEQ ID NO: 49044 - RNA, 16 nt, Homo sapiens
ccacgcucugggucgc

SEQ ID NO: 49045 - RNA, 18 nt, Homo sapiens
ccacgcucugggucgccg

SEQ ID NO: 49046 - RNA, 20 nt, Homo sapiens
ccacgcucugggucgccggc

SEQ ID NO: 49047 - RNA, 21 nt, Homo sapiens
ccacgcucugggucgccggca

SEQ ID NO: 49048 - RNA, 23 nt, Homo sapiens
ccacgcucugggucgccggcauc

SEQ ID NO: 49049 - RNA, 11 nt, Homo sapiens
ccacguuucua

SEQ ID NO: 49050 - RNA, 14 nt, Homo sapiens
ccacuacugcuacc

SEQ ID NO: 49051 - RNA, 13 nt, Homo sapiens
ccacucauucaaa

SEQ ID NO: 49052 - RNA, 18 nt, Homo sapiens
ccacugcagaagacagua

SEQ ID NO: 49053 - RNA, 12 nt, Homo sapiens
ccacuucacuuu

SEQ ID NO: 49054 - RNA, 15 nt, Homo sapiens
ccacuuccucccggc

SEQ ID NO: 49055 - RNA, 16 nt, Homo sapiens
ccacuuccucccggcc

SEQ ID NO: 49056 - RNA, 17 nt, Homo sapiens
ccacuuccucccggccg

SEQ ID NO: 49057 - RNA, 18 nt, Homo sapiens
ccacuuccucccggccgc

SEQ ID NO: 49058 - RNA, 19 nt, Homo sapiens
ccacuuccucccggccgcg

SEQ ID NO: 49059 - RNA, 20 nt, Homo sapiens
ccacuuccucccggccgcgc

SEQ ID NO: 49060 - RNA, 15 nt, Homo sapiens
ccacuuggacauggg

SEQ ID NO: 49061 - RNA, 21 nt, Homo sapiens
ccacuuuccaauaaagaguuc

SEQ ID NO: 49062 - RNA, 15 nt, Homo sapiens
ccacuuuuugcagcu

SEQ ID NO: 49063 - RNA, 14 nt, Homo sapiens
ccagaagucaaggc

SEQ ID NO: 49064 - RNA, 14 nt, Homo sapiens
ccagacuggcacag

SEQ ID NO: 49065 - RNA, 16 nt, Homo sapiens
ccagacuggcacaguu

SEQ ID NO: 49066 - RNA, 10 nt, Homo sapiens
ccagagacca

SEQ ID NO: 49067 - RNA, 18 nt, Homo sapiens
ccagagcguguagugaau

SEQ ID NO: 49068 - RNA, 23 nt, Homo sapiens
ccagaucaagccugccucaauca

SEQ ID NO: 49069 - RNA, 17 nt, Homo sapiens
ccagauuuuccugaaaa

SEQ ID NO: 49070 - RNA, 18 nt, Homo sapiens
ccagcacuuugggaggcu

SEQ ID NO: 49071 - RNA, 19 nt, Homo sapiens
ccagcacuuugggaggcug

SEQ ID NO: 49072 - RNA, 14 nt, Homo sapiens
ccagccacugugau

SEQ ID NO: 49073 - RNA, 16 nt, Homo sapiens
ccagcccuacaccauu

SEQ ID NO: 49074 - RNA, 20 nt, Homo sapiens
ccagccugggugacagagca

SEQ ID NO: 49075 - RNA, 15 nt, Homo sapiens
ccagccuugcuccug

SEQ ID NO: 49076 - RNA, 19 nt, Homo sapiens
ccagccuuggauacuccau

SEQ ID NO: 49077 - RNA, 14 nt, Homo sapiens
ccagcugccccggg

SEQ ID NO: 49078 - RNA, 21 nt, Homo sapiens
ccaggagauggaaguugcagu

SEQ ID NO: 49079 - RNA, 21 nt, Homo sapiens
ccaggaguuuggccagaaguc

SEQ ID NO: 49080 - RNA, 23 nt, Homo sapiens
ccaggaguuuggccagaagucaa

SEQ ID NO: 49081 - RNA, 16 nt, Homo sapiens
ccaggcacccccagaa

SEQ ID NO: 49082 - RNA, 12 nt, Homo sapiens
ccaggcggcugg

SEQ ID NO: 49083 - RNA, 14 nt, Homo sapiens
ccaggcggguccgg

SEQ ID NO: 49084 - RNA, 17 nt, Homo sapiens
ccaggcggguccggguc

SEQ ID NO: 49085 - RNA, 18 nt, Homo sapiens
ccaggcggguccgggucg

SEQ ID NO: 49086 - RNA, 20 nt, Homo sapiens
ccaggcggguccgggucgca

SEQ ID NO: 49087 - RNA, 21 nt, Homo sapiens
ccaggcggguccgggucgcag

SEQ ID NO: 49088 - RNA, 19 nt, Homo sapiens
ccagggacugaggggaggg

SEQ ID NO: 49089 - RNA, 19 nt, Homo sapiens
ccagggccuggcugggagu

SEQ ID NO: 49090 - RNA, 22 nt, Homo sapiens
ccagggccuggcugggaguggc

SEQ ID NO: 49091 - RNA, 11 nt, Homo sapiens
ccagggcuacg

SEQ ID NO: 49092 - RNA, 12 nt, Homo sapiens
ccagggcuacgc

SEQ ID NO: 49093 - RNA, 16 nt, Homo sapiens
ccagggcuacgcgcgc

SEQ ID NO: 49094 - RNA, 22 nt, Homo sapiens
ccagggcuacgcgcgcuccgcg

SEQ ID NO: 49095 - RNA, 24 nt, Homo sapiens
ccagggcuacgcgcgcuccgcgca

SEQ ID NO: 49096 - RNA, 16 nt, Homo sapiens
ccagguaccuucucac

SEQ ID NO: 49097 - RNA, 22 nt, Homo sapiens
ccagguagagagaccacaagca

SEQ ID NO: 49098 - RNA, 22 nt, Homo sapiens
ccaggucuaccaaaaaucucaa

SEQ ID NO: 49099 - RNA, 21 nt, Homo sapiens
ccaguaaaugggggugcauuu

SEQ ID NO: 49100 - RNA, 20 nt, Homo sapiens
ccagucugacuguuuccauc

SEQ ID NO: 49101 - RNA, 12 nt, Homo sapiens
ccagugagacag

SEQ ID NO: 49102 - RNA, 19 nt, Homo sapiens
ccagugagacagcucugca

SEQ ID NO: 49103 - RNA, 21 nt, Homo sapiens
ccagugagaucaaugugacgg

SEQ ID NO: 49104 - RNA, 17 nt, Homo sapiens
ccagugcuuuaauggca

SEQ ID NO: 49105 - RNA, 16 nt, Homo sapiens
ccaguguuguggauuu

SEQ ID NO: 49106 - RNA, 20 nt, Homo sapiens
ccauaaccccggaagccaaa

SEQ ID NO: 49107 - RNA, 15 nt, Homo sapiens
ccauagagacuuugu

SEQ ID NO: 49108 - RNA, 16 nt, Homo sapiens
ccauagagacuuugug

SEQ ID NO: 49109 - RNA, 13 nt, Homo sapiens
ccauagggugaca

SEQ ID NO: 49110 - RNA, 14 nt, Homo sapiens
ccauagggugacac

SEQ ID NO: 49111 - RNA, 15 nt, Homo sapiens
ccauagggugacaca

SEQ ID NO: 49112 - RNA, 21 nt, Homo sapiens
ccaucaaggguacacugccuu

SEQ ID NO: 49113 - RNA, 15 nt, Homo sapiens
ccaucauuuacuuuu

SEQ ID NO: 49114 - RNA, 11 nt, Homo sapiens
ccaucccggcc

SEQ ID NO: 49115 - RNA, 16 nt, Homo sapiens
ccaucccggccggcgc

SEQ ID NO: 49116 - RNA, 17 nt, Homo sapiens
ccaucccggccggcgcg

SEQ ID NO: 49117 - RNA, 18 nt, Homo sapiens
ccaucccggccggcgcgc

SEQ ID NO: 49118 - RNA, 20 nt, Homo sapiens
ccaucccggccggcgcgcuc

SEQ ID NO: 49119 - RNA, 18 nt, Homo sapiens
ccaugagaguucugucac

SEQ ID NO: 49120 - RNA, 22 nt, Homo sapiens
ccaugagaguucugucacgguc

SEQ ID NO: 49121 - RNA, 21 nt, Homo sapiens
ccaugaugcugagcccggaaa

SEQ ID NO: 49122 - RNA, 11 nt, Homo sapiens
ccaugcuggcc

SEQ ID NO: 49123 - RNA, 17 nt, Homo sapiens
ccaugcuggccaggcug

SEQ ID NO: 49124 - RNA, 17 nt, Homo sapiens
ccaugugauuacccucu

SEQ ID NO: 49125 - RNA, 20 nt, Homo sapiens
ccauucaggaugcccacggc

SEQ ID NO: 49126 - RNA, 22 nt, Homo sapiens
ccauucaggaugcccacggcug

SEQ ID NO: 49127 - RNA, 13 nt, Homo sapiens
ccauuccaagccu

SEQ ID NO: 49128 - RNA, 21 nt, Homo sapiens
ccauucuacauacuauggaau

SEQ ID NO: 49129 - RNA, 18 nt, Homo sapiens
ccauuguugucugcaacu

SEQ ID NO: 49130 - RNA, 13 nt, Homo sapiens
ccauuugagcucu

SEQ ID NO: 49131 - RNA, 15 nt, Homo sapiens
cccaaaacugauacc

SEQ ID NO: 49132 - RNA, 16 nt, Homo sapiens
cccaaaacugauaccc

SEQ ID NO: 49133 - RNA, 13 nt, Homo sapiens
cccaaaaggcaga

SEQ ID NO: 49134 - RNA, 15 nt, Homo sapiens
cccaaagugcuggga

SEQ ID NO: 49135 - RNA, 17 nt, Homo sapiens
cccaaagugugacucau

SEQ ID NO: 49136 - RNA, 16 nt, Homo sapiens
cccaaauuucauaccu

SEQ ID NO: 49137 - RNA, 20 nt, Homo sapiens
cccaaauuucauaccuauca

SEQ ID NO: 49138 - RNA, 13 nt, Homo sapiens
cccaagaaugaga

SEQ ID NO: 49139 - RNA, 22 nt, Homo sapiens
cccaagggaguuaggcuauuca

SEQ ID NO: 49140 - RNA, 16 nt, Homo sapiens
cccaaggguggguggg

SEQ ID NO: 49141 - RNA, 17 nt, Homo sapiens
cccaagggugggugggg

SEQ ID NO: 49142 - RNA, 21 nt, Homo sapiens
cccaaggguggguggggugag

SEQ ID NO: 49143 - RNA, 13 nt, Homo sapiens
cccacacugucca

SEQ ID NO: 49144 - RNA, 12 nt, Homo sapiens
cccacccgccca

SEQ ID NO: 49145 - RNA, 20 nt, Homo sapiens
cccacuuccucccggccgcg

SEQ ID NO: 49146 - RNA, 16 nt, Homo sapiens
cccagagcuacaggcc

SEQ ID NO: 49147 - RNA, 20 nt, Homo sapiens
cccagaucaagccugccuca

SEQ ID NO: 49148 - RNA, 15 nt, Homo sapiens
cccagcacuuuggga

SEQ ID NO: 49149 - RNA, 20 nt, Homo sapiens
cccagcacuuugggaggcug

SEQ ID NO: 49150 - RNA, 19 nt, Homo sapiens
cccagccccuugagaaacc

SEQ ID NO: 49151 - RNA, 24 nt, Homo sapiens
cccagcgagggacaccgaguggcc

SEQ ID NO: 49152 - RNA, 20 nt, Homo sapiens
cccagcuacuugggaggcug

SEQ ID NO: 49153 - RNA, 15 nt, Homo sapiens
cccagcuagaauuca

SEQ ID NO: 49154 - RNA, 13 nt, Homo sapiens
cccaggaguuugg

SEQ ID NO: 49155 - RNA, 18 nt, Homo sapiens
cccaggaguuuggccaga

SEQ ID NO: 49156 - RNA, 19 nt, Homo sapiens
cccaggaguuuggccagaa

SEQ ID NO: 49157 - RNA, 14 nt, Homo sapiens
cccaggcggguccg

SEQ ID NO: 49158 - RNA, 19 nt, Homo sapiens
cccagggcuugugugcaca

SEQ ID NO: 49159 - RNA, 21 nt, Homo sapiens
cccagggcuugugugcacaua

SEQ ID NO: 49160 - RNA, 13 nt, Homo sapiens
cccaucaucaccc

SEQ ID NO: 49161 - RNA, 18 nt, Homo sapiens
cccauucacagauaccuc

SEQ ID NO: 49162 - RNA, 19 nt, Homo sapiens
cccauucaggaugcccacg

SEQ ID NO: 49163 - RNA, 15 nt, Homo sapiens
cccauuucuauuuau

SEQ ID NO: 49164 - RNA, 14 nt, Homo sapiens
ccccaaguuaguuc

SEQ ID NO: 49165 - RNA, 17 nt, Homo sapiens
ccccaaguuaguucaau

SEQ ID NO: 49166 - RNA, 17 nt, Homo sapiens
ccccagagcuacaggcc

SEQ ID NO: 49167 - RNA, 20 nt, Homo sapiens
cccccauuguggucacagga

SEQ ID NO: 49168 - RNA, 21 nt, Homo sapiens
cccccauuguggucacaggaa

SEQ ID NO: 49169 - RNA, 22 nt, Homo sapiens
cccccauuguggucacaggaag

SEQ ID NO: 49170 - RNA, 11 nt, Homo sapiens
cccccgggccg

SEQ ID NO: 49171 - RNA, 12 nt, Homo sapiens
cccccgggccga

SEQ ID NO: 49172 - RNA, 18 nt, Homo sapiens
cccccgggccgacggagc

SEQ ID NO: 49173 - RNA, 19 nt, Homo sapiens
cccccgggccgacggagcc

SEQ ID NO: 49174 - RNA, 23 nt, Homo sapiens
cccccgggccgacggagccggga

SEQ ID NO: 49175 - RNA, 11 nt, Homo sapiens
ccccgggccga

SEQ ID NO: 49176 - RNA, 19 nt, Homo sapiens
ccccggggaggggcgcucg

SEQ ID NO: 49177 - RNA, 20 nt, Homo sapiens
ccccggggaggggcgcucgc

SEQ ID NO: 49178 - RNA, 21 nt, Homo sapiens
ccccggggaggggcgcucgcu

SEQ ID NO: 49179 - RNA, 15 nt, Homo sapiens
ccccucggagaagag

SEQ ID NO: 49180 - RNA, 22 nt, Homo sapiens
ccccugcacuccagccugagcg

SEQ ID NO: 49181 - RNA, 16 nt, Homo sapiens
cccgaaacuaccagcc

SEQ ID NO: 49182 - RNA, 12 nt, Homo sapiens
cccgcccaccgc

SEQ ID NO: 49183 - RNA, 15 nt, Homo sapiens
cccgcuguuccucgc

SEQ ID NO: 49184 - RNA, 16 nt, Homo sapiens
cccgcuguuccucgcc

SEQ ID NO: 49185 - RNA, 17 nt, Homo sapiens
cccgcuguuccucgcca

SEQ ID NO: 49186 - RNA, 19 nt, Homo sapiens
cccgcuguuccucgccacg

SEQ ID NO: 49187 - RNA, 21 nt, Homo sapiens
cccgcuguuccucgccacgcu

SEQ ID NO: 49188 - RNA, 13 nt, Homo sapiens
cccggccgcgcug

SEQ ID NO: 49189 - RNA, 14 nt, Homo sapiens
cccggccgcgcugc

SEQ ID NO: 49190 - RNA, 15 nt, Homo sapiens
cccggccgcgcugcg

SEQ ID NO: 49191 - RNA, 21 nt, Homo sapiens
cccggccgcgcugcgcgccgc

SEQ ID NO: 49192 - RNA, 14 nt, Homo sapiens
cccggccggcgcgc

SEQ ID NO: 49193 - RNA, 17 nt, Homo sapiens
cccggccggcgcgcuca

SEQ ID NO: 49194 - RNA, 19 nt, Homo sapiens
cccggccggcgcgcucauc

SEQ ID NO: 49195 - RNA, 11 nt, Homo sapiens
cccggccugau

SEQ ID NO: 49196 - RNA, 13 nt, Homo sapiens
cccgggaggcaga

SEQ ID NO: 49197 - RNA, 12 nt, Homo sapiens
cccgggaguggc

SEQ ID NO: 49198 - RNA, 13 nt, Homo sapiens
cccgggaguggcg

SEQ ID NO: 49199 - RNA, 19 nt, Homo sapiens
cccgggaguggcgcgcgcc

SEQ ID NO: 49200 - RNA, 23 nt, Homo sapiens
cccgggaguggcgcgcgccacca

SEQ ID NO: 49201 - RNA, 13 nt, Homo sapiens
cccgggccgacgg

SEQ ID NO: 49202 - RNA, 14 nt, Homo sapiens
cccgggccgacgga

SEQ ID NO: 49203 - RNA, 16 nt, Homo sapiens
cccgggccgacggagc

SEQ ID NO: 49204 - RNA, 17 nt, Homo sapiens
cccgggccgacggagcc

SEQ ID NO: 49205 - RNA, 21 nt, Homo sapiens
cccgggccgacggagccggga

SEQ ID NO: 49206 - RNA, 19 nt, Homo sapiens
cccggggaggggcgcucgc

SEQ ID NO: 49207 - RNA, 16 nt, Homo sapiens
cccgugugccugagcg

SEQ ID NO: 49208 - RNA, 11 nt, Homo sapiens
cccucaagaca

SEQ ID NO: 49209 - RNA, 12 nt, Homo sapiens
cccucaagacaa

SEQ ID NO: 49210 - RNA, 14 nt, Homo sapiens
cccucaugcugcca

SEQ ID NO: 49211 - RNA, 19 nt, Homo sapiens
cccucuccucucuuccucc

SEQ ID NO: 49212 - RNA, 15 nt, Homo sapiens
cccucuggcugcugg

SEQ ID NO: 49213 - RNA, 17 nt, Homo sapiens
cccucuggcugcuggug

SEQ ID NO: 49214 - RNA, 18 nt, Homo sapiens
cccucuggcugcuggugg

SEQ ID NO: 49215 - RNA, 19 nt, Homo sapiens
cccucuguugccaaggcug

SEQ ID NO: 49216 - RNA, 22 nt, Homo sapiens
cccucuguugccaaggcuggag

SEQ ID NO: 49217 - RNA, 16 nt, Homo sapiens
cccugaaagucccaga

SEQ ID NO: 49218 - RNA, 17 nt, Homo sapiens
cccugaaagucccagau

SEQ ID NO: 49219 - RNA, 19 nt, Homo sapiens
cccugaaagucccagauca

SEQ ID NO: 49220 - RNA, 16 nt, Homo sapiens
cccugaauuuaaauag

SEQ ID NO: 49221 - RNA, 15 nt, Homo sapiens
cccugagggucuggg

SEQ ID NO: 49222 - RNA, 18 nt, Homo sapiens
cccugcacuccagccuga

SEQ ID NO: 49223 - RNA, 12 nt, Homo sapiens
cccugccuggau

SEQ ID NO: 49224 - RNA, 18 nt, Homo sapiens
cccugccuggaucucaca

SEQ ID NO: 49225 - RNA, 15 nt, Homo sapiens
cccuggccuagcaua

SEQ ID NO: 49226 - RNA, 11 nt, Homo sapiens
cccuguacucc

SEQ ID NO: 49227 - RNA, 12 nt, Homo sapiens
cccuguacucca

SEQ ID NO: 49228 - RNA, 18 nt, Homo sapiens
cccuguacuccagccugg

SEQ ID NO: 49229 - RNA, 19 nt, Homo sapiens
cccuguacuccagccuggg

SEQ ID NO: 49230 - RNA, 12 nt, Homo sapiens
cccugugcggcc

SEQ ID NO: 49231 - RNA, 14 nt, Homo sapiens
cccugugcggccug

SEQ ID NO: 49232 - RNA, 12 nt, Homo sapiens
cccuuacaggaa

SEQ ID NO: 49233 - RNA, 17 nt, Homo sapiens
cccuucauguacaucca

SEQ ID NO: 49234 - RNA, 15 nt, Homo sapiens
cccuucccacacugu

SEQ ID NO: 49235 - RNA, 16 nt, Homo sapiens
cccuugaugaagaagu

SEQ ID NO: 49236 - RNA, 11 nt, Homo sapiens
cccuugccaug

SEQ ID NO: 49237 - RNA, 15 nt, Homo sapiens
cccuuggacauuuua

SEQ ID NO: 49238 - RNA, 18 nt, Homo sapiens
cccuuggacauuuuaugu

SEQ ID NO: 49239 - RNA, 19 nt, Homo sapiens
cccuuugaugauuaauuca

SEQ ID NO: 49240 - RNA, 13 nt, Homo sapiens
cccuuuuacauac

SEQ ID NO: 49241 - RNA, 14 nt, Homo sapiens
ccgaaacuaccagc

SEQ ID NO: 49242 - RNA, 15 nt, Homo sapiens
ccgaaacuaccagcc

SEQ ID NO: 49243 - RNA, 13 nt, Homo sapiens
ccgacggagccgg

SEQ ID NO: 49244 - RNA, 14 nt, Homo sapiens
ccgacggagccggg

SEQ ID NO: 49245 - RNA, 16 nt, Homo sapiens
ccgacggagccgggaa

SEQ ID NO: 49246 - RNA, 20 nt, Homo sapiens
ccgcagggugaacugcagcg

SEQ ID NO: 49247 - RNA, 19 nt, Homo sapiens
ccgcauccuagucucuauc

SEQ ID NO: 49248 - RNA, 18 nt, Homo sapiens
ccgcgcagcucaggcugg

SEQ ID NO: 49249 - RNA, 23 nt, Homo sapiens
ccgcgcagcucaggcuggcaccg

SEQ ID NO: 49250 - RNA, 11 nt, Homo sapiens
ccgcgcuccuc

SEQ ID NO: 49251 - RNA, 13 nt, Homo sapiens
ccgcgcuccucgg

SEQ ID NO: 49252 - RNA, 18 nt, Homo sapiens
ccgcgcuccucggacggc

SEQ ID NO: 49253 - RNA, 21 nt, Homo sapiens
ccgcgcuccucggacggcucc

SEQ ID NO: 49254 - RNA, 22 nt, Homo sapiens
ccgcgcuccucggacggcuccg

SEQ ID NO: 49255 - RNA, 23 nt, Homo sapiens
ccgcgcuccucggacggcuccgg

SEQ ID NO: 49256 - RNA, 14 nt, Homo sapiens
ccgcgcugcgcgcc

SEQ ID NO: 49257 - RNA, 15 nt, Homo sapiens
ccgcgcugcgcgccg

SEQ ID NO: 49258 - RNA, 16 nt, Homo sapiens
ccgcgcugcgcgccgc

SEQ ID NO: 49259 - RNA, 21 nt, Homo sapiens
ccgcgcugcgcgccgcgcucc

SEQ ID NO: 49260 - RNA, 23 nt, Homo sapiens
ccgcgcugcgcgccgcgcuccuc

SEQ ID NO: 49261 - RNA, 12 nt, Homo sapiens
ccgcuacuucca

SEQ ID NO: 49262 - RNA, 13 nt, Homo sapiens
ccgcuacuuccag

SEQ ID NO: 49263 - RNA, 15 nt, Homo sapiens
ccgcuacuuccaggg

SEQ ID NO: 49264 - RNA, 15 nt, Homo sapiens
ccgcuauccaccaaa

SEQ ID NO: 49265 - RNA, 16 nt, Homo sapiens
ccgcuauccaccaaaa

SEQ ID NO: 49266 - RNA, 20 nt, Homo sapiens
ccgcuguacgcgagcgcgcg

SEQ ID NO: 49267 - RNA, 14 nt, Homo sapiens
ccgcuguuccucgc

SEQ ID NO: 49268 - RNA, 16 nt, Homo sapiens
ccgcuguuccucgcca

SEQ ID NO: 49269 - RNA, 17 nt, Homo sapiens
ccgcuguuccucgccac

SEQ ID NO: 49270 - RNA, 19 nt, Homo sapiens
ccgcuguuccucgccacgc

SEQ ID NO: 49271 - RNA, 20 nt, Homo sapiens
ccgcuguuccucgccacgcu

SEQ ID NO: 49272 - RNA, 13 nt, Homo sapiens
ccggaaacuccac

SEQ ID NO: 49273 - RNA, 12 nt, Homo sapiens
ccggaagccaaa

SEQ ID NO: 49274 - RNA, 19 nt, Homo sapiens
ccggaagccaaaccucugu

SEQ ID NO: 49275 - RNA, 12 nt, Homo sapiens
ccggacgcugcu

SEQ ID NO: 49276 - RNA, 14 nt, Homo sapiens
ccggacgcugcugc

SEQ ID NO: 49277 - RNA, 15 nt, Homo sapiens
ccggacgcugcugcc

SEQ ID NO: 49278 - RNA, 16 nt, Homo sapiens
ccggacgcugcugccg

SEQ ID NO: 49279 - RNA, 19 nt, Homo sapiens
ccggacgcugcugccgugg

SEQ ID NO: 49280 - RNA, 23 nt, Homo sapiens
ccggagccccuugggcaggucac

SEQ ID NO: 49281 - RNA, 13 nt, Homo sapiens
ccggagccuccag

SEQ ID NO: 49282 - RNA, 15 nt, Homo sapiens
ccggagccuccagcu

SEQ ID NO: 49283 - RNA, 16 nt, Homo sapiens
ccggagccuccagcug

SEQ ID NO: 49284 - RNA, 22 nt, Homo sapiens
ccggagccuccagcugccccgg

SEQ ID NO: 49285 - RNA, 14 nt, Homo sapiens
ccggccgcgcugcg

SEQ ID NO: 49286 - RNA, 16 nt, Homo sapiens
ccggccgcgcugcgcg

SEQ ID NO: 49287 - RNA, 17 nt, Homo sapiens
ccggccgcgcugcgcgc

SEQ ID NO: 49288 - RNA, 12 nt, Homo sapiens
ccggccggcgcg

SEQ ID NO: 49289 - RNA, 13 nt, Homo sapiens
ccggccggcgcgc

SEQ ID NO: 49290 - RNA, 14 nt, Homo sapiens
ccggccggcgcgcu

SEQ ID NO: 49291 - RNA, 15 nt, Homo sapiens
ccggccggcgcgcuc

SEQ ID NO: 49292 - RNA, 11 nt, Homo sapiens
ccggcgcgcuc

SEQ ID NO: 49293 - RNA, 15 nt, Homo sapiens
ccggcgcgcucaucc

SEQ ID NO: 49294 - RNA, 20 nt, Homo sapiens
ccggcgcgcucaucccaccc

SEQ ID NO: 49295 - RNA, 16 nt, Homo sapiens
ccgggaaagaagagcc

SEQ ID NO: 49296 - RNA, 22 nt, Homo sapiens
ccgggaaagaagagccggagcc

SEQ ID NO: 49297 - RNA, 21 nt, Homo sapiens
ccgggaguggcgcgcgccacc

SEQ ID NO: 49298 - RNA, 22 nt, Homo sapiens
ccgggaguggcgcgcgccacca

SEQ ID NO: 49299 - RNA, 23 nt, Homo sapiens
ccgggaguggcgcgcgccaccac

SEQ ID NO: 49300 - RNA, 13 nt, Homo sapiens
ccgggcauggugg

SEQ ID NO: 49301 - RNA, 14 nt, Homo sapiens
ccgggccgacggag

SEQ ID NO: 49302 - RNA, 15 nt, Homo sapiens
ccgggccgacggagc

SEQ ID NO: 49303 - RNA, 17 nt, Homo sapiens
ccgggccgacggagccg

SEQ ID NO: 49304 - RNA, 18 nt, Homo sapiens
ccgggccgacggagccgg

SEQ ID NO: 49305 - RNA, 19 nt, Homo sapiens
ccgggcgcgguggcucacg

SEQ ID NO: 49306 - RNA, 13 nt, Homo sapiens
ccggggaggggcg

SEQ ID NO: 49307 - RNA, 15 nt, Homo sapiens
ccggggaggggcgcu

SEQ ID NO: 49308 - RNA, 16 nt, Homo sapiens
ccggggaggggcgcuc

SEQ ID NO: 49309 - RNA, 19 nt, Homo sapiens
ccggggaggggcgcucgcu

SEQ ID NO: 49310 - RNA, 16 nt, Homo sapiens
ccgguccuugcugcac

SEQ ID NO: 49311 - RNA, 20 nt, Homo sapiens
ccgucucccaaagugcuggg

SEQ ID NO: 49312 - RNA, 11 nt, Homo sapiens
ccgugggccug

SEQ ID NO: 49313 - RNA, 15 nt, Homo sapiens
ccgugugccugagcg

SEQ ID NO: 49314 - RNA, 22 nt, Homo sapiens
ccguguuacugccuaucagcau

SEQ ID NO: 49315 - RNA, 23 nt, Homo sapiens
ccguguuacugccuaucagcauu

SEQ ID NO: 49316 - RNA, 15 nt, Homo sapiens
ccuaaccucauuccc

SEQ ID NO: 49317 - RNA, 22 nt, Homo sapiens
ccuaaccucauuccccaaccac

SEQ ID NO: 49318 - RNA, 16 nt, Homo sapiens
ccuaagucccugcugc

SEQ ID NO: 49319 - RNA, 11 nt, Homo sapiens
ccuaauuuguu

SEQ ID NO: 49320 - RNA, 16 nt, Homo sapiens
ccuacaugagguacug

SEQ ID NO: 49321 - RNA, 15 nt, Homo sapiens
ccuagggugauauua

SEQ ID NO: 49322 - RNA, 11 nt, Homo sapiens
ccuaugaauaa

SEQ ID NO: 49323 - RNA, 18 nt, Homo sapiens
ccuaugaauaaauuuucu

SEQ ID NO: 49324 - RNA, 21 nt, Homo sapiens
ccucaguuuccugaccuauga

SEQ ID NO: 49325 - RNA, 12 nt, Homo sapiens
ccucaugcugcc

SEQ ID NO: 49326 - RNA, 14 nt, Homo sapiens
ccucaugcugccaa

SEQ ID NO: 49327 - RNA, 20 nt, Homo sapiens
ccucaugcugccaauauccu

SEQ ID NO: 49328 - RNA, 21 nt, Homo sapiens
ccucauggaauuggagcucgu

SEQ ID NO: 49329 - RNA, 13 nt, Homo sapiens
ccuccagcugccc

SEQ ID NO: 49330 - RNA, 15 nt, Homo sapiens
ccuccagcugccccg

SEQ ID NO: 49331 - RNA, 17 nt, Homo sapiens
ccuccagcugccccggg

SEQ ID NO: 49332 - RNA, 19 nt, Homo sapiens
ccuccaugaauaucaguua

SEQ ID NO: 49333 - RNA, 22 nt, Homo sapiens
ccuccaugaauaucaguuauuu

SEQ ID NO: 49334 - RNA, 23 nt, Homo sapiens
ccuccaugaauaucaguuauuuu

SEQ ID NO: 49335 - RNA, 13 nt, Homo sapiens
ccucccggccgcg

SEQ ID NO: 49336 - RNA, 15 nt, Homo sapiens
ccucccggccgcgcu

SEQ ID NO: 49337 - RNA, 16 nt, Homo sapiens
ccucccggccgcgcug

SEQ ID NO: 49338 - RNA, 20 nt, Homo sapiens
ccucccggccgcgcugcgcg

SEQ ID NO: 49339 - RNA, 21 nt, Homo sapiens
ccucccggccgcgcugcgcgc

SEQ ID NO: 49340 - RNA, 17 nt, Homo sapiens
ccucccuucucuucaca

SEQ ID NO: 49341 - RNA, 21 nt, Homo sapiens
ccucccuucucuucacaguca

SEQ ID NO: 49342 - RNA, 13 nt, Homo sapiens
ccuccgcuacuuc

SEQ ID NO: 49343 - RNA, 12 nt, Homo sapiens
ccucgccacgcu

SEQ ID NO: 49344 - RNA, 16 nt, Homo sapiens
ccucgccacgcucugg

SEQ ID NO: 49345 - RNA, 16 nt, Homo sapiens
ccucggacggcuccgg

SEQ ID NO: 49346 - RNA, 20 nt, Homo sapiens
ccucggacggcuccggacgc

SEQ ID NO: 49347 - RNA, 22 nt, Homo sapiens
ccucggacggcuccggacgcug

SEQ ID NO: 49348 - RNA, 14 nt, Homo sapiens
ccucuauugccaug

SEQ ID NO: 49349 - RNA, 10 nt, Homo sapiens
ccucucccaa

SEQ ID NO: 49350 - RNA, 16 nt, Homo sapiens
ccucucccaacuauaa

SEQ ID NO: 49351 - RNA, 20 nt, Homo sapiens
ccucucucauccacuuucca

SEQ ID NO: 49352 - RNA, 21 nt, Homo sapiens
ccucucucauccacuuuccaa

SEQ ID NO: 49353 - RNA, 16 nt, Homo sapiens
ccucugcuauuugcug

SEQ ID NO: 49354 - RNA, 10 nt, Homo sapiens
ccucuggcug

SEQ ID NO: 49355 - RNA, 22 nt, Homo sapiens
ccucuggcugcugguggcgcug

SEQ ID NO: 49356 - RNA, 14 nt, Homo sapiens
ccucuguugccaag

SEQ ID NO: 49357 - RNA, 15 nt, Homo sapiens
ccucuguugccaagg

SEQ ID NO: 49358 - RNA, 14 nt, Homo sapiens
ccucuugcaauuca

SEQ ID NO: 49359 - RNA, 17 nt, Homo sapiens
ccugaaagucccagauc

SEQ ID NO: 49360 - RNA, 19 nt, Homo sapiens
ccugaauuuaaauagcuuu

SEQ ID NO: 49361 - RNA, 15 nt, Homo sapiens
ccugagaccaaggcc

SEQ ID NO: 49362 - RNA, 18 nt, Homo sapiens
ccugagaccaaggccccc

SEQ ID NO: 49363 - RNA, 19 nt, Homo sapiens
ccugagaccaaggcccccg

SEQ ID NO: 49364 - RNA, 13 nt, Homo sapiens
ccugagaccagcc

SEQ ID NO: 49365 - RNA, 14 nt, Homo sapiens
ccugagaccagcca

SEQ ID NO: 49366 - RNA, 11 nt, Homo sapiens
ccugagcccca

SEQ ID NO: 49367 - RNA, 20 nt, Homo sapiens
ccugagcccuacugugucuc

SEQ ID NO: 49368 - RNA, 18 nt, Homo sapiens
ccugauucauauuuaauu

SEQ ID NO: 49369 - RNA, 13 nt, Homo sapiens
ccugcagacauga

SEQ ID NO: 49370 - RNA, 16 nt, Homo sapiens
ccugccaccuccugcc

SEQ ID NO: 49371 - RNA, 16 nt, Homo sapiens
ccugccaugcucucca

SEQ ID NO: 49372 - RNA, 21 nt, Homo sapiens
ccugcccuuacaggaacagaa

SEQ ID NO: 49373 - RNA, 12 nt, Homo sapiens
ccugcucgccca

SEQ ID NO: 49374 - RNA, 13 nt, Homo sapiens
ccugcucgcccac

SEQ ID NO: 49375 - RNA, 20 nt, Homo sapiens
ccuggacaguuuucugcuuu

SEQ ID NO: 49376 - RNA, 22 nt, Homo sapiens
ccuggacaguuuucugcuuuaa

SEQ ID NO: 49377 - RNA, 20 nt, Homo sapiens
ccuggaucucacaagcacuu

SEQ ID NO: 49378 - RNA, 14 nt, Homo sapiens
ccuggauggcugcc

SEQ ID NO: 49379 - RNA, 19 nt, Homo sapiens
ccuggauuccucacuuuga

SEQ ID NO: 49380 - RNA, 15 nt, Homo sapiens
ccuggccgcagugag

SEQ ID NO: 49381 - RNA, 16 nt, Homo sapiens
ccuggcugggaguggc

SEQ ID NO: 49382 - RNA, 18 nt, Homo sapiens
ccuggcugggaguggcau

SEQ ID NO: 49383 - RNA, 22 nt, Homo sapiens
ccuggcugggaguggcauguau

SEQ ID NO: 49384 - RNA, 20 nt, Homo sapiens
ccuggcuggggccuguugaa

SEQ ID NO: 49385 - RNA, 19 nt, Homo sapiens
ccuggucaacauggugaaa

SEQ ID NO: 49386 - RNA, 17 nt, Homo sapiens
ccuggucuaccuguucg

SEQ ID NO: 49387 - RNA, 18 nt, Homo sapiens
ccuggucuaccuguucgc

SEQ ID NO: 49388 - RNA, 20 nt, Homo sapiens
ccuggucuaccuguucgcgc

SEQ ID NO: 49389 - RNA, 16 nt, Homo sapiens
ccuguaaucccagcac

SEQ ID NO: 49390 - RNA, 17 nt, Homo sapiens
ccuguaaucccagcuac

SEQ ID NO: 49391 - RNA, 19 nt, Homo sapiens
ccugugaaauaguucaaag

SEQ ID NO: 49392 - RNA, 16 nt, Homo sapiens
ccugugacugucucac

SEQ ID NO: 49393 - RNA, 11 nt, Homo sapiens
ccugugcggcc

SEQ ID NO: 49394 - RNA, 13 nt, Homo sapiens
ccugugcggccug

SEQ ID NO: 49395 - RNA, 21 nt, Homo sapiens
ccuguguuucuagggaaauga

SEQ ID NO: 49396 - RNA, 22 nt, Homo sapiens
ccuguuaaaagaugaaaauauu

SEQ ID NO: 49397 - RNA, 13 nt, Homo sapiens
ccuguucgcgcgc

SEQ ID NO: 49398 - RNA, 15 nt, Homo sapiens
ccuguucgcgcgccu

SEQ ID NO: 49399 - RNA, 23 nt, Homo sapiens
ccuuaaacucagggagcauuuau

SEQ ID NO: 49400 - RNA, 18 nt, Homo sapiens
ccuuagcccaucuuucaa

SEQ ID NO: 49401 - RNA, 14 nt, Homo sapiens
ccuuauuguaccuc

SEQ ID NO: 49402 - RNA, 16 nt, Homo sapiens
ccuuauuguaccucuc

SEQ ID NO: 49403 - RNA, 16 nt, Homo sapiens
ccuucauguacaucca

SEQ ID NO: 49404 - RNA, 17 nt, Homo sapiens
ccuucccacacugucca

SEQ ID NO: 49405 - RNA, 15 nt, Homo sapiens
ccuucuggguucaag

SEQ ID NO: 49406 - RNA, 16 nt, Homo sapiens
ccuucuuacaaugcau

SEQ ID NO: 49407 - RNA, 11 nt, Homo sapiens
ccuugagaaac

SEQ ID NO: 49408 - RNA, 13 nt, Homo sapiens
ccuugaugaagaa

SEQ ID NO: 49409 - RNA, 14 nt, Homo sapiens
ccuugaugaagaag

SEQ ID NO: 49410 - RNA, 22 nt, Homo sapiens
ccuugcugcaccugugccgucc

SEQ ID NO: 49411 - RNA, 14 nt, Homo sapiens
ccuuuagaauauua

SEQ ID NO: 49412 - RNA, 18 nt, Homo sapiens
ccuuuggaugcacuuuau

SEQ ID NO: 49413 - RNA, 14 nt, Homo sapiens
ccuuugggaaagga

SEQ ID NO: 49414 - RNA, 13 nt, Homo sapiens
ccuuuuacauacu

SEQ ID NO: 49415 - RNA, 10 nt, Homo sapiens
ccuuuuuccu

SEQ ID NO: 49416 - RNA, 15 nt, Homo sapiens
ccuuuuuguuauuag

SEQ ID NO: 49417 - RNA, 22 nt, Homo sapiens
cgaacugcuggauucaagugau

SEQ ID NO: 49418 - RNA, 21 nt, Homo sapiens
cgaagucuuccauagagacuu

SEQ ID NO: 49419 - RNA, 17 nt, Homo sapiens
cgaaugguuccauucuc

SEQ ID NO: 49420 - RNA, 18 nt, Homo sapiens
cgaaugguuccauucucu

SEQ ID NO: 49421 - RNA, 22 nt, Homo sapiens
cgacagugagacucugucucag

SEQ ID NO: 49422 - RNA, 12 nt, Homo sapiens
cgacaguuuucc

SEQ ID NO: 49423 - RNA, 11 nt, Homo sapiens
cgacggagccg

SEQ ID NO: 49424 - RNA, 13 nt, Homo sapiens
cgacggagccggg

SEQ ID NO: 49425 - RNA, 14 nt, Homo sapiens
cgacggagccggga

SEQ ID NO: 49426 - RNA, 15 nt, Homo sapiens
cgacggagccgggaa

SEQ ID NO: 49427 - RNA, 20 nt, Homo sapiens
cgagaaccuaaguuucaguu

SEQ ID NO: 49428 - RNA, 17 nt, Homo sapiens
cgagcaggcuacuguca

SEQ ID NO: 49429 - RNA, 13 nt, Homo sapiens
cgagccccaggcg

SEQ ID NO: 49430 - RNA, 14 nt, Homo sapiens
cgagccccaggcgg

SEQ ID NO: 49431 - RNA, 15 nt, Homo sapiens
cgagccccaggcggg

SEQ ID NO: 49432 - RNA, 19 nt, Homo sapiens
cgagccccaggcggguccg

SEQ ID NO: 49433 - RNA, 13 nt, Homo sapiens
cgagcgcgcgcgc

SEQ ID NO: 49434 - RNA, 14 nt, Homo sapiens
cgagcgcgcgcgcc

SEQ ID NO: 49435 - RNA, 18 nt, Homo sapiens
cgagcgcuaccucuccag

SEQ ID NO: 49436 - RNA, 16 nt, Homo sapiens
cgagcguugcuggggg

SEQ ID NO: 49437 - RNA, 17 nt, Homo sapiens
cgaguacuucccgcugu

SEQ ID NO: 49438 - RNA, 14 nt, Homo sapiens
cgauccccugucac

SEQ ID NO: 49439 - RNA, 21 nt, Homo sapiens
cgauucucuuuauucagcccc

SEQ ID NO: 49440 - RNA, 20 nt, Homo sapiens
cgauuucuguuuagauaaua

SEQ ID NO: 49441 - RNA, 18 nt, Homo sapiens
cgcaccuguaaucccagc

SEQ ID NO: 49442 - RNA, 13 nt, Homo sapiens
cgcagcucaggcu

SEQ ID NO: 49443 - RNA, 17 nt, Homo sapiens
cgcagcucaggcuggca

SEQ ID NO: 49444 - RNA, 19 nt, Homo sapiens
cgcagcucaggcuggcacc

SEQ ID NO: 49445 - RNA, 11 nt, Homo sapiens
cgcaggaccau

SEQ ID NO: 49446 - RNA, 18 nt, Homo sapiens
cgcaggaccaucccggcc

SEQ ID NO: 49447 - RNA, 21 nt, Homo sapiens
cgcaggaccaucccggccggc

SEQ ID NO: 49448 - RNA, 23 nt, Homo sapiens
cgcaggaccaucccggccggcgc

SEQ ID NO: 49449 - RNA, 19 nt, Homo sapiens
cgcagggugaacugcagcg

SEQ ID NO: 49450 - RNA, 17 nt, Homo sapiens
cgccacgcucugggucg

SEQ ID NO: 49451 - RNA, 19 nt, Homo sapiens
cgccacgcucugggucgcc

SEQ ID NO: 49452 - RNA, 20 nt, Homo sapiens
cgccacgcucugggucgccg

SEQ ID NO: 49453 - RNA, 22 nt, Homo sapiens
cgccacgcucugggucgccggc

SEQ ID NO: 49454 - RNA, 13 nt, Homo sapiens
cgcccaccgcagg

SEQ ID NO: 49455 - RNA, 14 nt, Homo sapiens
cgcccaccgcaggg

SEQ ID NO: 49456 - RNA, 14 nt, Homo sapiens
cgcccacuuccucc

SEQ ID NO: 49457 - RNA, 16 nt, Homo sapiens
cgcccacuuccucccg

SEQ ID NO: 49458 - RNA, 19 nt, Homo sapiens
cgcccacuuccucccggcc

SEQ ID NO: 49459 - RNA, 20 nt, Homo sapiens
cgcccacuuccucccggccg

SEQ ID NO: 49460 - RNA, 23 nt, Homo sapiens
cgcccacuuccucccggccgcgc

SEQ ID NO: 49461 - RNA, 21 nt, Homo sapiens
cgcccagcuaauuuguguauu

SEQ ID NO: 49462 - RNA, 12 nt, Homo sapiens
cgcccucuggcu

SEQ ID NO: 49463 - RNA, 13 nt, Homo sapiens
cgcccucuggcug

SEQ ID NO: 49464 - RNA, 14 nt, Homo sapiens
cgcccucuggcugc

SEQ ID NO: 49465 - RNA, 16 nt, Homo sapiens
cgcccucuggcugcug

SEQ ID NO: 49466 - RNA, 17 nt, Homo sapiens
cgcccucuggcugcugg

SEQ ID NO: 49467 - RNA, 19 nt, Homo sapiens
cgcccucuggcugcuggug

SEQ ID NO: 49468 - RNA, 21 nt, Homo sapiens
cgcccucuggcugcugguggc

SEQ ID NO: 49469 - RNA, 22 nt, Homo sapiens
cgcccucuggcugcugguggcg

SEQ ID NO: 49470 - RNA, 14 nt, Homo sapiens
cgccgcgcuccucg

SEQ ID NO: 49471 - RNA, 16 nt, Homo sapiens
cgccgcgcuccucgga

SEQ ID NO: 49472 - RNA, 18 nt, Homo sapiens
cgccgcgcuccucggacg

SEQ ID NO: 49473 - RNA, 20 nt, Homo sapiens
cgccgcgcuccucggacggc

SEQ ID NO: 49474 - RNA, 22 nt, Homo sapiens
cgccgcgcuccucggacggcuc

SEQ ID NO: 49475 - RNA, 23 nt, Homo sapiens
cgccgcgcuccucggacggcucc

SEQ ID NO: 49476 - RNA, 14 nt, Homo sapiens
cgccggcaucuucu

SEQ ID NO: 49477 - RNA, 17 nt, Homo sapiens
cgccuccgcuacuucca

SEQ ID NO: 49478 - RNA, 13 nt, Homo sapiens
cgcgagcgcgcgc

SEQ ID NO: 49479 - RNA, 14 nt, Homo sapiens
cgcgagcgcgcgcg

SEQ ID NO: 49480 - RNA, 15 nt, Homo sapiens
cgcgagcgcgcgcgc

SEQ ID NO: 49481 - RNA, 20 nt, Homo sapiens
cgcgagcgcgcgcgcccucu

SEQ ID NO: 49482 - RNA, 11 nt, Homo sapiens
cgcgcaccugu

SEQ ID NO: 49483 - RNA, 19 nt, Homo sapiens
cgcgcagcucaggcuggca

SEQ ID NO: 49484 - RNA, 11 nt, Homo sapiens
cgcgccaccac

SEQ ID NO: 49485 - RNA, 12 nt, Homo sapiens
cgcgccaccacg

SEQ ID NO: 49486 - RNA, 13 nt, Homo sapiens
cgcgccaccacgc

SEQ ID NO: 49487 - RNA, 14 nt, Homo sapiens
cgcgccaccacgcc

SEQ ID NO: 49488 - RNA, 15 nt, Homo sapiens
cgcgccaccacgccc

SEQ ID NO: 49489 - RNA, 16 nt, Homo sapiens
cgcgccaccacgccca

SEQ ID NO: 49490 - RNA, 18 nt, Homo sapiens
cgcgccaccacgcccagc

SEQ ID NO: 49491 - RNA, 12 nt, Homo sapiens
cgcgcccucugg

SEQ ID NO: 49492 - RNA, 19 nt, Homo sapiens
cgcgcccucuggcugcugg

SEQ ID NO: 49493 - RNA, 22 nt, Homo sapiens
cgcgcccucuggcugcuggugg

SEQ ID NO: 49494 - RNA, 24 nt, Homo sapiens
cgcgcccucuggcugcugguggcg

SEQ ID NO: 49495 - RNA, 12 nt, Homo sapiens
cgcgccgcgcuc

SEQ ID NO: 49496 - RNA, 13 nt, Homo sapiens
cgcgccgcgcucc

SEQ ID NO: 49497 - RNA, 14 nt, Homo sapiens
cgcgccgcgcuccu

SEQ ID NO: 49498 - RNA, 16 nt, Homo sapiens
cgcgccgcgcuccucg

SEQ ID NO: 49499 - RNA, 12 nt, Homo sapiens
cgcgcgccacca

SEQ ID NO: 49500 - RNA, 20 nt, Homo sapiens
cgcgcgccaccacgcccagc

SEQ ID NO: 49501 - RNA, 11 nt, Homo sapiens
cgcgcgcccuc

SEQ ID NO: 49502 - RNA, 16 nt, Homo sapiens
cgcgcgcccucuggcu

SEQ ID NO: 49503 - RNA, 21 nt, Homo sapiens
cgcgcgcccucuggcugcugg

SEQ ID NO: 49504 - RNA, 11 nt, Homo sapiens
cgcgcgccucc

SEQ ID NO: 49505 - RNA, 13 nt, Homo sapiens
cgcgcgccuccgc

SEQ ID NO: 49506 - RNA, 13 nt, Homo sapiens
cgcgcgcuccgcg

SEQ ID NO: 49507 - RNA, 14 nt, Homo sapiens
cgcgcgcuccgcgc

SEQ ID NO: 49508 - RNA, 17 nt, Homo sapiens
cgcgcgcuccgcgcagc

SEQ ID NO: 49509 - RNA, 12 nt, Homo sapiens
cgcgcucauccc

SEQ ID NO: 49510 - RNA, 15 nt, Homo sapiens
cgcgcucaucccacc

SEQ ID NO: 49511 - RNA, 18 nt, Homo sapiens
cgcgcucaucccacccgc

SEQ ID NO: 49512 - RNA, 20 nt, Homo sapiens
cgcgcucaucccacccgccc

SEQ ID NO: 49513 - RNA, 21 nt, Homo sapiens
cgcgcucaucccacccgccca

SEQ ID NO: 49514 - RNA, 12 nt, Homo sapiens
cgcgcuccgcgc

SEQ ID NO: 49515 - RNA, 13 nt, Homo sapiens
cgcgcuccgcgca

SEQ ID NO: 49516 - RNA, 17 nt, Homo sapiens
cgcgcuccgcgcagcuc

SEQ ID NO: 49517 - RNA, 15 nt, Homo sapiens
cgcgcuccucggacg

SEQ ID NO: 49518 - RNA, 20 nt, Homo sapiens
cgcgcuccucggacggcucc

SEQ ID NO: 49519 - RNA, 12 nt, Homo sapiens
cgcgcugcgcgc

SEQ ID NO: 49520 - RNA, 15 nt, Homo sapiens
cgcgcugcgcgccgc

SEQ ID NO: 49521 - RNA, 16 nt, Homo sapiens
cgcgcugcgcgccgcg

SEQ ID NO: 49522 - RNA, 18 nt, Homo sapiens
cgcgcugcgcgccgcgcu

SEQ ID NO: 49523 - RNA, 18 nt, Homo sapiens
cgcggcgggagggcgcgg

SEQ ID NO: 49524 - RNA, 20 nt, Homo sapiens
cgcggcgggagggcgcgggg

SEQ ID NO: 49525 - RNA, 21 nt, Homo sapiens
cgcggcgggagggcgcggggc

SEQ ID NO: 49526 - RNA, 23 nt, Homo sapiens
cgcggcgggagggcgcggggcgg

SEQ ID NO: 49527 - RNA, 11 nt, Homo sapiens
cgcggggcggg

SEQ ID NO: 49528 - RNA, 12 nt, Homo sapiens
cgcggggcgggg

SEQ ID NO: 49529 - RNA, 15 nt, Homo sapiens
cgcggggcggggagc

SEQ ID NO: 49530 - RNA, 12 nt, Homo sapiens
cgcgugcaggca

SEQ ID NO: 49531 - RNA, 11 nt, Homo sapiens
cgcuacuucca

SEQ ID NO: 49532 - RNA, 13 nt, Homo sapiens
cgcucaucccacc

SEQ ID NO: 49533 - RNA, 17 nt, Homo sapiens
cgcucaucccacccgcc

SEQ ID NO: 49534 - RNA, 18 nt, Homo sapiens
cgcucaucccacccgccc

SEQ ID NO: 49535 - RNA, 19 nt, Homo sapiens
cgcucaucccacccgccca

SEQ ID NO: 49536 - RNA, 22 nt, Homo sapiens
cgcucaucccacccgcccaccg

SEQ ID NO: 49537 - RNA, 13 nt, Homo sapiens
cgcuccgcgcagc

SEQ ID NO: 49538 - RNA, 19 nt, Homo sapiens
cgcuccgcgcagcucaggc

SEQ ID NO: 49539 - RNA, 20 nt, Homo sapiens
cgcuccgcgcagcucaggcu

SEQ ID NO: 49540 - RNA, 12 nt, Homo sapiens
cgcuccucggac

SEQ ID NO: 49541 - RNA, 13 nt, Homo sapiens
cgcuccucggacg

SEQ ID NO: 49542 - RNA, 15 nt, Homo sapiens
cgcuccucggacggc

SEQ ID NO: 49543 - RNA, 16 nt, Homo sapiens
cgcuccucggacggcu

SEQ ID NO: 49544 - RNA, 18 nt, Homo sapiens
cgcuccucggacggcucc

SEQ ID NO: 49545 - RNA, 14 nt, Homo sapiens
cgcucgcuuccgca

SEQ ID NO: 49546 - RNA, 21 nt, Homo sapiens
cgcucgcuuccgcauccuagu

SEQ ID NO: 49547 - RNA, 10 nt, Homo sapiens
cgcucggccu

SEQ ID NO: 49548 - RNA, 12 nt, Homo sapiens
cgcucggccugc

SEQ ID NO: 49549 - RNA, 16 nt, Homo sapiens
cgcucggccugcucgc

SEQ ID NO: 49550 - RNA, 13 nt, Homo sapiens
cgcucugggucgc

SEQ ID NO: 49551 - RNA, 14 nt, Homo sapiens
cgcugcgcgccgcg

SEQ ID NO: 49552 - RNA, 15 nt, Homo sapiens
cgcugcgcgccgcgc

SEQ ID NO: 49553 - RNA, 17 nt, Homo sapiens
cgcugcgcgccgcgcuc

SEQ ID NO: 49554 - RNA, 13 nt, Homo sapiens
cgcugcugccgug

SEQ ID NO: 49555 - RNA, 19 nt, Homo sapiens
cgcugcugccgugggccug

SEQ ID NO: 49556 - RNA, 11 nt, Homo sapiens
cgcuggcugcg

SEQ ID NO: 49557 - RNA, 14 nt, Homo sapiens
cgcuggcugcgcuc

SEQ ID NO: 49558 - RNA, 15 nt, Homo sapiens
cgcuggcugcgcucg

SEQ ID NO: 49559 - RNA, 17 nt, Homo sapiens
cgcuggcugcgcucggc

SEQ ID NO: 49560 - RNA, 18 nt, Homo sapiens
cgcuggcugcgcucggcc

SEQ ID NO: 49561 - RNA, 20 nt, Homo sapiens
cgcuggcugcgcucggccug

SEQ ID NO: 49562 - RNA, 22 nt, Homo sapiens
cgcuggcugcgcucggccugcu

SEQ ID NO: 49563 - RNA, 12 nt, Homo sapiens
cgcuguuccucg

SEQ ID NO: 49564 - RNA, 14 nt, Homo sapiens
cgcuguuccucgcc

SEQ ID NO: 49565 - RNA, 15 nt, Homo sapiens
cgcuguuccucgcca

SEQ ID NO: 49566 - RNA, 17 nt, Homo sapiens
cgcuguuccucgccacg

SEQ ID NO: 49567 - RNA, 19 nt, Homo sapiens
cgcuguuccucgccacgcu

SEQ ID NO: 49568 - RNA, 20 nt, Homo sapiens
cgcuguuccucgccacgcuc

SEQ ID NO: 49569 - RNA, 22 nt, Homo sapiens
cgcuguuccucgccacgcucug

SEQ ID NO: 49570 - RNA, 15 nt, Homo sapiens
cgcuuccgcauccua

SEQ ID NO: 49571 - RNA, 15 nt, Homo sapiens
cgcuuuugauaauca

SEQ ID NO: 49572 - RNA, 12 nt, Homo sapiens
cggaacaguauc

SEQ ID NO: 49573 - RNA, 12 nt, Homo sapiens
cggacgcugcug

SEQ ID NO: 49574 - RNA, 13 nt, Homo sapiens
cggacgcugcugc

SEQ ID NO: 49575 - RNA, 14 nt, Homo sapiens
cggacgcugcugcc

SEQ ID NO: 49576 - RNA, 20 nt, Homo sapiens
cggacgcugcugccgugggc

SEQ ID NO: 49577 - RNA, 23 nt, Homo sapiens
cggacgcugcugccgugggccug

SEQ ID NO: 49578 - RNA, 15 nt, Homo sapiens
cggacggcuccggac

SEQ ID NO: 49579 - RNA, 17 nt, Homo sapiens
cggacggcuccggacgc

SEQ ID NO: 49580 - RNA, 20 nt, Homo sapiens
cggagaagagcuguucacag

SEQ ID NO: 49581 - RNA, 11 nt, Homo sapiens
cggagauaucc

SEQ ID NO: 49582 - RNA, 21 nt, Homo sapiens
cggagccccuugggcagguca

SEQ ID NO: 49583 - RNA, 17 nt, Homo sapiens
cggagccgggaaagaag

SEQ ID NO: 49584 - RNA, 20 nt, Homo sapiens
cggagccgggaaagaagagc

SEQ ID NO: 49585 - RNA, 14 nt, Homo sapiens
cggagccuccagcu

SEQ ID NO: 49586 - RNA, 18 nt, Homo sapiens
cggagccuccagcugccc

SEQ ID NO: 49587 - RNA, 19 nt, Homo sapiens
cggagccuccagcugcccc

SEQ ID NO: 49588 - RNA, 12 nt, Homo sapiens
cggcccugugcg

SEQ ID NO: 49589 - RNA, 14 nt, Homo sapiens
cggcccugugcggc

SEQ ID NO: 49590 - RNA, 15 nt, Homo sapiens
cggcccugugcggcc

SEQ ID NO: 49591 - RNA, 16 nt, Homo sapiens
cggcccugugcggccu

SEQ ID NO: 49592 - RNA, 18 nt, Homo sapiens
cggcccugugcggccugg

SEQ ID NO: 49593 - RNA, 19 nt, Homo sapiens
cggcccugugcggccuggu

SEQ ID NO: 49594 - RNA, 12 nt, Homo sapiens
cggccgcgcugc

SEQ ID NO: 49595 - RNA, 15 nt, Homo sapiens
cggccgcgcugcgcg

SEQ ID NO: 49596 - RNA, 18 nt, Homo sapiens
cggccgcgcugcgcgccg

SEQ ID NO: 49597 - RNA, 20 nt, Homo sapiens
cggccgcgcugcgcgccgcg

SEQ ID NO: 49598 - RNA, 21 nt, Homo sapiens
cggccgcgcugcgcgccgcgc

SEQ ID NO: 49599 - RNA, 22 nt, Homo sapiens
cggccgcgcugcgcgccgcgcu

SEQ ID NO: 49600 - RNA, 11 nt, Homo sapiens
cggccggcgcg

SEQ ID NO: 49601 - RNA, 13 nt, Homo sapiens
cggccggcgcgcu

SEQ ID NO: 49602 - RNA, 12 nt, Homo sapiens
cggccugcucgc

SEQ ID NO: 49603 - RNA, 14 nt, Homo sapiens
cggccugcucgccc

SEQ ID NO: 49604 - RNA, 21 nt, Homo sapiens
cggccugcucgcccacuuccu

SEQ ID NO: 49605 - RNA, 22 nt, Homo sapiens
cggccuggucuaccuguucgcg

SEQ ID NO: 49606 - RNA, 23 nt, Homo sapiens
cggccuggucuaccuguucgcgc

SEQ ID NO: 49607 - RNA, 21 nt, Homo sapiens
cggcgcgcucaucccacccgc

SEQ ID NO: 49608 - RNA, 14 nt, Homo sapiens
cggcggcccugugc

SEQ ID NO: 49609 - RNA, 17 nt, Homo sapiens
cggcggcccugugcggc

SEQ ID NO: 49610 - RNA, 18 nt, Homo sapiens
cggcggcccugugcggcc

SEQ ID NO: 49611 - RNA, 21 nt, Homo sapiens
cggcggcccugugcggccugg

SEQ ID NO: 49612 - RNA, 23 nt, Homo sapiens
cggcggcccugugcggccugguc

SEQ ID NO: 49613 - RNA, 13 nt, Homo sapiens
cggcgggagggcg

SEQ ID NO: 49614 - RNA, 18 nt, Homo sapiens
cggcgggagggcgcgggg

SEQ ID NO: 49615 - RNA, 19 nt, Homo sapiens
cggcgggagggcgcggggc

SEQ ID NO: 49616 - RNA, 20 nt, Homo sapiens
cggcgggagggcgcggggcg

SEQ ID NO: 49617 - RNA, 22 nt, Homo sapiens
cggcgggagggcgcggggcggg

SEQ ID NO: 49618 - RNA, 18 nt, Homo sapiens
cggcuccggacgcugcug

SEQ ID NO: 49619 - RNA, 19 nt, Homo sapiens
cggcuccggacgcugcugc

SEQ ID NO: 49620 - RNA, 20 nt, Homo sapiens
cggcuccggacgcugcugcc

SEQ ID NO: 49621 - RNA, 15 nt, Homo sapiens
cggcuggagcugccu

SEQ ID NO: 49622 - RNA, 13 nt, Homo sapiens
cgggaaagaagag

SEQ ID NO: 49623 - RNA, 15 nt, Homo sapiens
cgggaaagaagagcc

SEQ ID NO: 49624 - RNA, 17 nt, Homo sapiens
cgggaaagaagagccgg

SEQ ID NO: 49625 - RNA, 21 nt, Homo sapiens
cgggaaagaagagccggagcc

SEQ ID NO: 49626 - RNA, 23 nt, Homo sapiens
cgggaaagaagagccggagccuc

SEQ ID NO: 49627 - RNA, 12 nt, Homo sapiens
cgggacacaggc

SEQ ID NO: 49628 - RNA, 16 nt, Homo sapiens
cgggagggcgcggggc

SEQ ID NO: 49629 - RNA, 14 nt, Homo sapiens
cgggaguggcgcgc

SEQ ID NO: 49630 - RNA, 15 nt, Homo sapiens
cgggaguggcgcgcg

SEQ ID NO: 49631 - RNA, 16 nt, Homo sapiens
cgggaguggcgcgcgc

SEQ ID NO: 49632 - RNA, 17 nt, Homo sapiens
cgggaguggcgcgcgcc

SEQ ID NO: 49633 - RNA, 18 nt, Homo sapiens
cgggaguggcgcgcgcca

SEQ ID NO: 49634 - RNA, 20 nt, Homo sapiens
cgggaguggcgcgcgccacc

SEQ ID NO: 49635 - RNA, 11 nt, Homo sapiens
cgggcauggug

SEQ ID NO: 49636 - RNA, 12 nt, Homo sapiens
cgggcauggugg

SEQ ID NO: 49637 - RNA, 11 nt, Homo sapiens
cgggccgacgg

SEQ ID NO: 49638 - RNA, 14 nt, Homo sapiens
cgggccgacggagc

SEQ ID NO: 49639 - RNA, 19 nt, Homo sapiens
cgggccgacggagccggga

SEQ ID NO: 49640 - RNA, 13 nt, Homo sapiens
cggggagcgagcc

SEQ ID NO: 49641 - RNA, 15 nt, Homo sapiens
cggggagcgagcccc

SEQ ID NO: 49642 - RNA, 13 nt, Homo sapiens
cggggaggggcgc

SEQ ID NO: 49643 - RNA, 15 nt, Homo sapiens
cggggaggggcgcuc

SEQ ID NO: 49644 - RNA, 16 nt, Homo sapiens
cggggaggggcgcucg

SEQ ID NO: 49645 - RNA, 17 nt, Homo sapiens
cggggaggggcgcucgc

SEQ ID NO: 49646 - RNA, 19 nt, Homo sapiens
cggggaggggcgcucgcuu

SEQ ID NO: 49647 - RNA, 21 nt, Homo sapiens
cggggaggggcgcucgcuucc

SEQ ID NO: 49648 - RNA, 22 nt, Homo sapiens
cggggaggggcgcucgcuuccg

SEQ ID NO: 49649 - RNA, 19 nt, Homo sapiens
cggggcggggagcgagccc

SEQ ID NO: 49650 - RNA, 20 nt, Homo sapiens
cggggcggggagcgagcccc

SEQ ID NO: 49651 - RNA, 14 nt, Homo sapiens
cgggguuugccaug

SEQ ID NO: 49652 - RNA, 18 nt, Homo sapiens
cgggguuugccaugcugg

SEQ ID NO: 49653 - RNA, 23 nt, Homo sapiens
cgggguuugccaugcuggccagg

SEQ ID NO: 49654 - RNA, 14 nt, Homo sapiens
cggguccgggucgc

SEQ ID NO: 49655 - RNA, 19 nt, Homo sapiens
cggguccgggucgcaggac

SEQ ID NO: 49656 - RNA, 21 nt, Homo sapiens
cggguccgggucgcaggacca

SEQ ID NO: 49657 - RNA, 13 nt, Homo sapiens
cggguggaucacu

SEQ ID NO: 49658 - RNA, 21 nt, Homo sapiens
cggucacuuuacuguccccau

SEQ ID NO: 49659 - RNA, 15 nt, Homo sapiens
cgguccuugcugcac

SEQ ID NO: 49660 - RNA, 20 nt, Homo sapiens
cgguuugaaaauaugccugc

SEQ ID NO: 49661 - RNA, 21 nt, Homo sapiens
cguccccagagcuacaggccc

SEQ ID NO: 49662 - RNA, 11 nt, Homo sapiens
cguccuuccac

SEQ ID NO: 49663 - RNA, 20 nt, Homo sapiens
cguccuuccacuuccaagau

SEQ ID NO: 49664 - RNA, 18 nt, Homo sapiens
cgucucccaaagugcugg

SEQ ID NO: 49665 - RNA, 20 nt, Homo sapiens
cgucucuacuaaaaauacaa

SEQ ID NO: 49666 - RNA, 23 nt, Homo sapiens
cgucuugacuuuggcaaaugagc

SEQ ID NO: 49667 - RNA, 16 nt, Homo sapiens
cgugaccugacagccc

SEQ ID NO: 49668 - RNA, 17 nt, Homo sapiens
cgugaccugacagccca

SEQ ID NO: 49669 - RNA, 14 nt, Homo sapiens
cgugacuggccugc

SEQ ID NO: 49670 - RNA, 15 nt, Homo sapiens
cgugacuggccugcu

SEQ ID NO: 49671 - RNA, 16 nt, Homo sapiens
cgugacuggccugcug

SEQ ID NO: 49672 - RNA, 17 nt, Homo sapiens
cgugacuggccugcugg

SEQ ID NO: 49673 - RNA, 12 nt, Homo sapiens
cgugagccacca

SEQ ID NO: 49674 - RNA, 16 nt, Homo sapiens
cgugagccaccaaacc

SEQ ID NO: 49675 - RNA, 19 nt, Homo sapiens
cgugauuuugcuguagaag

SEQ ID NO: 49676 - RNA, 16 nt, Homo sapiens
cguggaacaguuaccu

SEQ ID NO: 49677 - RNA, 13 nt, Homo sapiens
cgugggccugaga

SEQ ID NO: 49678 - RNA, 17 nt, Homo sapiens
cgugggccugagaccaa

SEQ ID NO: 49679 - RNA, 19 nt, Homo sapiens
cgugguaggacuguagaaa

SEQ ID NO: 49680 - RNA, 16 nt, Homo sapiens
cgugugggcaauguuc

SEQ ID NO: 49681 - RNA, 15 nt, Homo sapiens
cguuugugauugcca

SEQ ID NO: 49682 - RNA, 17 nt, Homo sapiens
cguuugugauugccauu

SEQ ID NO: 49683 - RNA, 17 nt, Homo sapiens
cuaaaaaacaaagaaga

SEQ ID NO: 49684 - RNA, 18 nt, Homo sapiens
cuaaaaaggcauguaauu

SEQ ID NO: 49685 - RNA, 16 nt, Homo sapiens
cuaaaacaccucagcu

SEQ ID NO: 49686 - RNA, 17 nt, Homo sapiens
cuaaaacaccucagcug

SEQ ID NO: 49687 - RNA, 17 nt, Homo sapiens
cuaaaaggccugucccu

SEQ ID NO: 49688 - RNA, 18 nt, Homo sapiens
cuaaacuuucacacccca

SEQ ID NO: 49689 - RNA, 16 nt, Homo sapiens
cuaaaguguauuuuuu

SEQ ID NO: 49690 - RNA, 17 nt, Homo sapiens
cuaaaguguauuuuuuu

SEQ ID NO: 49691 - RNA, 21 nt, Homo sapiens
cuaaaguguauuuuuuuacua

SEQ ID NO: 49692 - RNA, 19 nt, Homo sapiens
cuaaauaucccuuggacau

SEQ ID NO: 49693 - RNA, 23 nt, Homo sapiens
cuaaauucuuucauuuuaggggu

SEQ ID NO: 49694 - RNA, 15 nt, Homo sapiens
cuaaauuugguucua

SEQ ID NO: 49695 - RNA, 21 nt, Homo sapiens
cuaacaggaauuuucauuguu

SEQ ID NO: 49696 - RNA, 16 nt, Homo sapiens
cuaaccagccugguca

SEQ ID NO: 49697 - RNA, 21 nt, Homo sapiens
cuaagaagugaaaaucuacac

SEQ ID NO: 49698 - RNA, 14 nt, Homo sapiens
cuaagcauuccaac

SEQ ID NO: 49699 - RNA, 18 nt, Homo sapiens
cuaaguaaaaccacagca

SEQ ID NO: 49700 - RNA, 23 nt, Homo sapiens
cuaagugaaauaagccagacauc

SEQ ID NO: 49701 - RNA, 19 nt, Homo sapiens
cuaauaaaaaggugaccau

SEQ ID NO: 49702 - RNA, 19 nt, Homo sapiens
cuaauaaaauacauacuau

SEQ ID NO: 49703 - RNA, 18 nt, Homo sapiens
cuaauagaauuaauggaa

SEQ ID NO: 49704 - RNA, 20 nt, Homo sapiens
cuaaucaauacuuugaacac

SEQ ID NO: 49705 - RNA, 22 nt, Homo sapiens
cuaauuuguuuucccuucuuac

SEQ ID NO: 49706 - RNA, 18 nt, Homo sapiens
cuaauuuuauuauaguaa

SEQ ID NO: 49707 - RNA, 13 nt, Homo sapiens
cuacaaaaacaca

SEQ ID NO: 49708 - RNA, 16 nt, Homo sapiens
cuacaaaaacacagca

SEQ ID NO: 49709 - RNA, 13 nt, Homo sapiens
cuacaauuguaaa

SEQ ID NO: 49710 - RNA, 20 nt, Homo sapiens
cuacacuaagagagaaugag

SEQ ID NO: 49711 - RNA, 14 nt, Homo sapiens
cuacacuccaguga

SEQ ID NO: 49712 - RNA, 17 nt, Homo sapiens
cuacacuccagugagac

SEQ ID NO: 49713 - RNA, 18 nt, Homo sapiens
cuacagccaggcggcugg

SEQ ID NO: 49714 - RNA, 19 nt, Homo sapiens
cuaccagcccuacaccauu

SEQ ID NO: 49715 - RNA, 16 nt, Homo sapiens
cuaccuguucgcgcgc

SEQ ID NO: 49716 - RNA, 17 nt, Homo sapiens
cuaccuguucgcgcgcc

SEQ ID NO: 49717 - RNA, 12 nt, Homo sapiens
cuacgcgcgcuc

SEQ ID NO: 49718 - RNA, 14 nt, Homo sapiens
cuacgcgcgcuccg

SEQ ID NO: 49719 - RNA, 15 nt, Homo sapiens
cuacgcgcgcuccgc

SEQ ID NO: 49720 - RNA, 16 nt, Homo sapiens
cuacgcgcgcuccgcg

SEQ ID NO: 49721 - RNA, 18 nt, Homo sapiens
cuacgcgcgcuccgcgca

SEQ ID NO: 49722 - RNA, 20 nt, Homo sapiens
cuacgcgcgcuccgcgcagc

SEQ ID NO: 49723 - RNA, 21 nt, Homo sapiens
cuacgcgcgcuccgcgcagcu

SEQ ID NO: 49724 - RNA, 24 nt, Homo sapiens
cuacucuguuccuucacauccugu

SEQ ID NO: 49725 - RNA, 16 nt, Homo sapiens
cuacuuccagggcuac

SEQ ID NO: 49726 - RNA, 19 nt, Homo sapiens
cuacuuccagggcuacgcg

SEQ ID NO: 49727 - RNA, 22 nt, Homo sapiens
cuacuuccagggcuacgcgcgc

SEQ ID NO: 49728 - RNA, 17 nt, Homo sapiens
cuagaaaacaggcaaau

SEQ ID NO: 49729 - RNA, 19 nt, Homo sapiens
cuagaaaacaggcaaauuc

SEQ ID NO: 49730 - RNA, 14 nt, Homo sapiens
cuagaauacuaaua

SEQ ID NO: 49731 - RNA, 16 nt, Homo sapiens
cuagaauucacuccac

SEQ ID NO: 49732 - RNA, 15 nt, Homo sapiens
cuagauacugaaugu

SEQ ID NO: 49733 - RNA, 17 nt, Homo sapiens
cuagcauacguacacau

SEQ ID NO: 49734 - RNA, 19 nt, Homo sapiens
cuagcccuuacguccuucc

SEQ ID NO: 49735 - RNA, 14 nt, Homo sapiens
cuagcuaauaucaa

SEQ ID NO: 49736 - RNA, 16 nt, Homo sapiens
cuagcuaauaucaaua

SEQ ID NO: 49737 - RNA, 13 nt, Homo sapiens
cuaggaaauauuu

SEQ ID NO: 49738 - RNA, 11 nt, Homo sapiens
cuaggccgggc

SEQ ID NO: 49739 - RNA, 19 nt, Homo sapiens
cuagggugauauuaaccag

SEQ ID NO: 49740 - RNA, 17 nt, Homo sapiens
cuaguaauuggaaaggc

SEQ ID NO: 49741 - RNA, 12 nt, Homo sapiens
cuaguauuucua

SEQ ID NO: 49742 - RNA, 13 nt, Homo sapiens
cuaguauuucuau

SEQ ID NO: 49743 - RNA, 14 nt, Homo sapiens
cuagucucuaucau

SEQ ID NO: 49744 - RNA, 20 nt, Homo sapiens
cuagucucuaucauuaaagu

SEQ ID NO: 49745 - RNA, 22 nt, Homo sapiens
cuagucucuaucauuaaaguuc

SEQ ID NO: 49746 - RNA, 22 nt, Homo sapiens
cuagugaaagaggcagcuugaa

SEQ ID NO: 49747 - RNA, 15 nt, Homo sapiens
cuaguuguaauuuuu

SEQ ID NO: 49748 - RNA, 17 nt, Homo sapiens
cuaguuguaauuuuuuu

SEQ ID NO: 49749 - RNA, 15 nt, Homo sapiens
cuauauccugugacu

SEQ ID NO: 49750 - RNA, 18 nt, Homo sapiens
cuauauuaucaugcaaau

SEQ ID NO: 49751 - RNA, 20 nt, Homo sapiens
cuaucaaguauuauaccuuu

SEQ ID NO: 49752 - RNA, 18 nt, Homo sapiens
cuaucauuaaaguucuag

SEQ ID NO: 49753 - RNA, 23 nt, Homo sapiens
cuauccaccaaaagggcucccug

SEQ ID NO: 49754 - RNA, 15 nt, Homo sapiens
cuaucucauuuccaa

SEQ ID NO: 49755 - RNA, 18 nt, Homo sapiens
cuaugaauaaauuuucuu

SEQ ID NO: 49756 - RNA, 21 nt, Homo sapiens
cuaugaauaaauuuucuucuu

SEQ ID NO: 49757 - RNA, 12 nt, Homo sapiens
cuaugcauuuga

SEQ ID NO: 49758 - RNA, 20 nt, Homo sapiens
cuauguagaauauauuuccu

SEQ ID NO: 49759 - RNA, 13 nt, Homo sapiens
cuaugugauuaca

SEQ ID NO: 49760 - RNA, 15 nt, Homo sapiens
cuaugugauuacaag

SEQ ID NO: 49761 - RNA, 15 nt, Homo sapiens
cuauguggcuguauc

SEQ ID NO: 49762 - RNA, 17 nt, Homo sapiens
cuauguggcuguaucuu

SEQ ID NO: 49763 - RNA, 18 nt, Homo sapiens
cuauguucuaagaaguga

SEQ ID NO: 49764 - RNA, 15 nt, Homo sapiens
cuauguuguugcacu

SEQ ID NO: 49765 - RNA, 16 nt, Homo sapiens
cuauguuguugcacuu

SEQ ID NO: 49766 - RNA, 13 nt, Homo sapiens
cuauugccaugag

SEQ ID NO: 49767 - RNA, 14 nt, Homo sapiens
cuauuuaagagaac

SEQ ID NO: 49768 - RNA, 18 nt, Homo sapiens
cuauuuaauuauuucacu

SEQ ID NO: 49769 - RNA, 19 nt, Homo sapiens
cuauuuaauuauuucacuu

SEQ ID NO: 49770 - RNA, 21 nt, Homo sapiens
cuauuuaauuauuucacuuua

SEQ ID NO: 49771 - RNA, 14 nt, Homo sapiens
cuauuuacggaacu

SEQ ID NO: 49772 - RNA, 18 nt, Homo sapiens
cuauuuacggaacucaaa

SEQ ID NO: 49773 - RNA, 18 nt, Homo sapiens
cuauuuauuaaguauuuu

SEQ ID NO: 49774 - RNA, 14 nt, Homo sapiens
cuauuuauuuauuu

SEQ ID NO: 49775 - RNA, 21 nt, Homo sapiens
cuauuuauuuauuuauucauu

SEQ ID NO: 49776 - RNA, 22 nt, Homo sapiens
cuauuuauuuauuuauucauua

SEQ ID NO: 49777 - RNA, 18 nt, Homo sapiens
cuauuuauuuauuuauuu

SEQ ID NO: 49778 - RNA, 22 nt, Homo sapiens
cuauuuauuuauuuauuuauuu

SEQ ID NO: 49779 - RNA, 11 nt, Homo sapiens
cucaaaacugc

SEQ ID NO: 49780 - RNA, 16 nt, Homo sapiens
cucaaaacugcacugu

SEQ ID NO: 49781 - RNA, 18 nt, Homo sapiens
cucaaaacuucagacaua

SEQ ID NO: 49782 - RNA, 22 nt, Homo sapiens
cucaaaauaccaugccauuuaa

SEQ ID NO: 49783 - RNA, 23 nt, Homo sapiens
cucaaauacgugggcauucaaau

SEQ ID NO: 49784 - RNA, 18 nt, Homo sapiens
cucaacauaacauaagcu

SEQ ID NO: 49785 - RNA, 16 nt, Homo sapiens
cucaaccaccuuucag

SEQ ID NO: 49786 - RNA, 15 nt, Homo sapiens
cucaagacaaaugac

SEQ ID NO: 49787 - RNA, 12 nt, Homo sapiens
cucaagccagcc

SEQ ID NO: 49788 - RNA, 21 nt, Homo sapiens
cucaauguuuagcagauuuaa

SEQ ID NO: 49789 - RNA, 13 nt, Homo sapiens
cucacaagcacuu

SEQ ID NO: 49790 - RNA, 14 nt, Homo sapiens
cucacaagcacuuu

SEQ ID NO: 49791 - RNA, 12 nt, Homo sapiens
cucaccugugag

SEQ ID NO: 49792 - RNA, 12 nt, Homo sapiens
cucacuuugaag

SEQ ID NO: 49793 - RNA, 21 nt, Homo sapiens
cucacuuugaagagugugagg

SEQ ID NO: 49794 - RNA, 15 nt, Homo sapiens
cucagaaacaucagu

SEQ ID NO: 49795 - RNA, 21 nt, Homo sapiens
cucagcuaaugaaguguuuag

SEQ ID NO: 49796 - RNA, 16 nt, Homo sapiens
cucagcugccucccca

SEQ ID NO: 49797 - RNA, 17 nt, Homo sapiens
cucaggcuggcaccgcu

SEQ ID NO: 49798 - RNA, 14 nt, Homo sapiens
cucagguguccgcu

SEQ ID NO: 49799 - RNA, 21 nt, Homo sapiens
cucagugucaaugcagccccc

SEQ ID NO: 49800 - RNA, 20 nt, Homo sapiens
cucaguguccucaucuguaa

SEQ ID NO: 49801 - RNA, 16 nt, Homo sapiens
cucaguugcagcccug

SEQ ID NO: 49802 - RNA, 13 nt, Homo sapiens
cucaucaaucaaa

SEQ ID NO: 49803 - RNA, 14 nt, Homo sapiens
cucaucccacccgc

SEQ ID NO: 49804 - RNA, 16 nt, Homo sapiens
cucaucccacccgccc

SEQ ID NO: 49805 - RNA, 19 nt, Homo sapiens
cucauggaauuggagcucg

SEQ ID NO: 49806 - RNA, 20 nt, Homo sapiens
cucauggaauuggagcucgu

SEQ ID NO: 49807 - RNA, 23 nt, Homo sapiens
cucauggaauuggagcucgugga

SEQ ID NO: 49808 - RNA, 12 nt, Homo sapiens
cucauucaaaag

SEQ ID NO: 49809 - RNA, 21 nt, Homo sapiens
cucauuuauuuccauauuaaa

SEQ ID NO: 49810 - RNA, 20 nt, Homo sapiens
cucauuuuaaaaaauggaac

SEQ ID NO: 49811 - RNA, 17 nt, Homo sapiens
cucauuuuuguuuucau

SEQ ID NO: 49812 - RNA, 14 nt, Homo sapiens
cuccaaacuggagc

SEQ ID NO: 49813 - RNA, 15 nt, Homo sapiens
cuccaaacuggagcu

SEQ ID NO: 49814 - RNA, 22 nt, Homo sapiens
cuccaaagaaauguaagggaaa

SEQ ID NO: 49815 - RNA, 15 nt, Homo sapiens
cuccaagaauuucua

SEQ ID NO: 49816 - RNA, 21 nt, Homo sapiens
cuccaccuuacuucuucucau

SEQ ID NO: 49817 - RNA, 12 nt, Homo sapiens
cuccaccuucug

SEQ ID NO: 49818 - RNA, 14 nt, Homo sapiens
cuccaccuucuggg

SEQ ID NO: 49819 - RNA, 16 nt, Homo sapiens
cuccaccuucuggguu

SEQ ID NO: 49820 - RNA, 18 nt, Homo sapiens
cuccacuuggacaugggc

SEQ ID NO: 49821 - RNA, 17 nt, Homo sapiens
cuccagccucagcucuc

SEQ ID NO: 49822 - RNA, 13 nt, Homo sapiens
cuccagccugagc

SEQ ID NO: 49823 - RNA, 15 nt, Homo sapiens
cuccagccugagcga

SEQ ID NO: 49824 - RNA, 16 nt, Homo sapiens
cuccagccugagcgac

SEQ ID NO: 49825 - RNA, 12 nt, Homo sapiens
cuccagcugccc

SEQ ID NO: 49826 - RNA, 13 nt, Homo sapiens
cuccagcugcccc

SEQ ID NO: 49827 - RNA, 15 nt, Homo sapiens
cuccagugagacagc

SEQ ID NO: 49828 - RNA, 20 nt, Homo sapiens
cuccagugagacagcucugc

SEQ ID NO: 49829 - RNA, 21 nt, Homo sapiens
cuccagugagacagcucugca

SEQ ID NO: 49830 - RNA, 20 nt, Homo sapiens
cuccaugaauaucaguuauu

SEQ ID NO: 49831 - RNA, 20 nt, Homo sapiens
cuccauggggugggggugga

SEQ ID NO: 49832 - RNA, 16 nt, Homo sapiens
cucccaaagugcuggg

SEQ ID NO: 49833 - RNA, 15 nt, Homo sapiens
cucccagucauuuaa

SEQ ID NO: 49834 - RNA, 15 nt, Homo sapiens
cucccauucacagau

SEQ ID NO: 49835 - RNA, 11 nt, Homo sapiens
cucccggccgc

SEQ ID NO: 49836 - RNA, 14 nt, Homo sapiens
cucccggccgcgcu

SEQ ID NO: 49837 - RNA, 16 nt, Homo sapiens
cucccggccgcgcugc

SEQ ID NO: 49838 - RNA, 22 nt, Homo sapiens
cucccuauuuuuuuucuguuau

SEQ ID NO: 49839 - RNA, 23 nt, Homo sapiens
cucccuauuuuuuuucuguuaua

SEQ ID NO: 49840 - RNA, 24 nt, Homo sapiens
cucccuauuuuuuuucuguuauau

SEQ ID NO: 49841 - RNA, 12 nt, Homo sapiens
cuccgcauccuc

SEQ ID NO: 49842 - RNA, 21 nt, Homo sapiens
cuccgcauccuccuccugcuu

SEQ ID NO: 49843 - RNA, 19 nt, Homo sapiens
cuccgcgcagcucaggcug

SEQ ID NO: 49844 - RNA, 14 nt, Homo sapiens
cuccgcuacuucca

SEQ ID NO: 49845 - RNA, 15 nt, Homo sapiens
cuccgcuacuuccag

SEQ ID NO: 49846 - RNA, 16 nt, Homo sapiens
cuccgcuacuuccagg

SEQ ID NO: 49847 - RNA, 14 nt, Homo sapiens
cuccggacgcugcu

SEQ ID NO: 49848 - RNA, 16 nt, Homo sapiens
cuccggacgcugcugc

SEQ ID NO: 49849 - RNA, 18 nt, Homo sapiens
cuccggacgcugcugccg

SEQ ID NO: 49850 - RNA, 23 nt, Homo sapiens
cuccggacgcugcugccgugggc

SEQ ID NO: 49851 - RNA, 14 nt, Homo sapiens
cuccgucucccaaa

SEQ ID NO: 49852 - RNA, 14 nt, Homo sapiens
cuccuccuucaugg

SEQ ID NO: 49853 - RNA, 13 nt, Homo sapiens
cuccucggacggc

SEQ ID NO: 49854 - RNA, 14 nt, Homo sapiens
cuccucggacggcu

SEQ ID NO: 49855 - RNA, 16 nt, Homo sapiens
cuccucggacggcucc

SEQ ID NO: 49856 - RNA, 22 nt, Homo sapiens
cuccucggacggcuccggacgc

SEQ ID NO: 49857 - RNA, 23 nt, Homo sapiens
cuccugagacacaugggugcuau

SEQ ID NO: 49858 - RNA, 10 nt, Homo sapiens
cuccugccuc

SEQ ID NO: 49859 - RNA, 23 nt, Homo sapiens
cuccuggcuggggccuguugaag

SEQ ID NO: 49860 - RNA, 16 nt, Homo sapiens
cuccuuguguuacuaa

SEQ ID NO: 49861 - RNA, 12 nt, Homo sapiens
cucgaacugcug

SEQ ID NO: 49862 - RNA, 14 nt, Homo sapiens
cucgaacugcugga

SEQ ID NO: 49863 - RNA, 15 nt, Homo sapiens
cucgaacugcuggau

SEQ ID NO: 49864 - RNA, 11 nt, Homo sapiens
cucgaaucacu

SEQ ID NO: 49865 - RNA, 14 nt, Homo sapiens
cucgaaucacucau

SEQ ID NO: 49866 - RNA, 15 nt, Homo sapiens
cucgcccacuuccuc

SEQ ID NO: 49867 - RNA, 11 nt, Homo sapiens
cucgcuuccgc

SEQ ID NO: 49868 - RNA, 22 nt, Homo sapiens
cucgcuuccgcauccuagucuc

SEQ ID NO: 49869 - RNA, 14 nt, Homo sapiens
cucggacggcuccg

SEQ ID NO: 49870 - RNA, 15 nt, Homo sapiens
cucggacggcuccgg

SEQ ID NO: 49871 - RNA, 18 nt, Homo sapiens
cucggacggcuccggacg

SEQ ID NO: 49872 - RNA, 19 nt, Homo sapiens
cucggacggcuccggacgc

SEQ ID NO: 49873 - RNA, 22 nt, Homo sapiens
cucggagggauuccccuaaccu

SEQ ID NO: 49874 - RNA, 12 nt, Homo sapiens
cucggccugcuc

SEQ ID NO: 49875 - RNA, 13 nt, Homo sapiens
cucggccugcucg

SEQ ID NO: 49876 - RNA, 15 nt, Homo sapiens
cucggccugcucgcc

SEQ ID NO: 49877 - RNA, 16 nt, Homo sapiens
cucggccugcucgccc

SEQ ID NO: 49878 - RNA, 21 nt, Homo sapiens
cucggccugcucgcccacuuc

SEQ ID NO: 49879 - RNA, 22 nt, Homo sapiens
cucggccugcucgcccacuucc

SEQ ID NO: 49880 - RNA, 13 nt, Homo sapiens
cucguggaacagu

SEQ ID NO: 49881 - RNA, 13 nt, Homo sapiens
cucuaaaugucaa

SEQ ID NO: 49882 - RNA, 20 nt, Homo sapiens
cucuacuaaaaauacaaaaa

SEQ ID NO: 49883 - RNA, 13 nt, Homo sapiens
cucuaggaaauau

SEQ ID NO: 49884 - RNA, 20 nt, Homo sapiens
cucucacuuguuuuauuuaa

SEQ ID NO: 49885 - RNA, 15 nt, Homo sapiens
cucuccaugauccca

SEQ ID NO: 49886 - RNA, 23 nt, Homo sapiens
cucuccaugaucccaccucccau

SEQ ID NO: 49887 - RNA, 14 nt, Homo sapiens
cucucugaccuccu

SEQ ID NO: 49888 - RNA, 19 nt, Homo sapiens
cucucuuauagaauauuua

SEQ ID NO: 49889 - RNA, 14 nt, Homo sapiens
cucucuuguagcuc

SEQ ID NO: 49890 - RNA, 21 nt, Homo sapiens
cucucuuuuuagagaaauuug

SEQ ID NO: 49891 - RNA, 22 nt, Homo sapiens
cucugaagaguggguuucacaa

SEQ ID NO: 49892 - RNA, 19 nt, Homo sapiens
cucugaaggguaauuauau

SEQ ID NO: 49893 - RNA, 23 nt, Homo sapiens
cucugaccuccuccuucauggca

SEQ ID NO: 49894 - RNA, 21 nt, Homo sapiens
cucugauacagaaaaguugaa

SEQ ID NO: 49895 - RNA, 22 nt, Homo sapiens
cucugauacagaaaaguugaau

SEQ ID NO: 49896 - RNA, 19 nt, Homo sapiens
cucugcuauuugcuguuau

SEQ ID NO: 49897 - RNA, 12 nt, Homo sapiens
cucuggaaacca

SEQ ID NO: 49898 - RNA, 16 nt, Homo sapiens
cucuggaagccucuau

SEQ ID NO: 49899 - RNA, 22 nt, Homo sapiens
cucuggaagccucuauugccau

SEQ ID NO: 49900 - RNA, 17 nt, Homo sapiens
cucuggcgacaguuuuc

SEQ ID NO: 49901 - RNA, 14 nt, Homo sapiens
cucuggcugcuggu

SEQ ID NO: 49902 - RNA, 21 nt, Homo sapiens
cucuggcugcugguggcgcug

SEQ ID NO: 49903 - RNA, 23 nt, Homo sapiens
cucuggcugcugguggcgcuggc

SEQ ID NO: 49904 - RNA, 14 nt, Homo sapiens
cucugggucgccgg

SEQ ID NO: 49905 - RNA, 15 nt, Homo sapiens
cucugggucgccggc

SEQ ID NO: 49906 - RNA, 13 nt, Homo sapiens
cucugggucucag

SEQ ID NO: 49907 - RNA, 18 nt, Homo sapiens
cucugucucaguccauga

SEQ ID NO: 49908 - RNA, 21 nt, Homo sapiens
cucugugaacgauuuagaaag

SEQ ID NO: 49909 - RNA, 17 nt, Homo sapiens
cucuguuccuucacauc

SEQ ID NO: 49910 - RNA, 13 nt, Homo sapiens
cucuuaagaagac

SEQ ID NO: 49911 - RNA, 16 nt, Homo sapiens
cucuuaagaagacugc

SEQ ID NO: 49912 - RNA, 23 nt, Homo sapiens
cucuugcaauucaauacagauca

SEQ ID NO: 49913 - RNA, 16 nt, Homo sapiens
cucuuuauucagcccc

SEQ ID NO: 49914 - RNA, 17 nt, Homo sapiens
cugaaaacccuugccau

SEQ ID NO: 49915 - RNA, 12 nt, Homo sapiens
cugaaauuuccu

SEQ ID NO: 49916 - RNA, 22 nt, Homo sapiens
cugaaccauggucggaaaacau

SEQ ID NO: 49917 - RNA, 15 nt, Homo sapiens
cugaaccguuuguga

SEQ ID NO: 49918 - RNA, 13 nt, Homo sapiens
cugaagaagcacc

SEQ ID NO: 49919 - RNA, 14 nt, Homo sapiens
cugaagaagcacca

SEQ ID NO: 49920 - RNA, 21 nt, Homo sapiens
cugaagaguggguuucacaag

SEQ ID NO: 49921 - RNA, 17 nt, Homo sapiens
cugaagggcaucaugca

SEQ ID NO: 49922 - RNA, 20 nt, Homo sapiens
cugaagggcaucaugcaucu

SEQ ID NO: 49923 - RNA, 12 nt, Homo sapiens
cugaauuucuuu

SEQ ID NO: 49924 - RNA, 13 nt, Homo sapiens
cugaauuucuuuu

SEQ ID NO: 49925 - RNA, 14 nt, Homo sapiens
cugacucuuaagaa

SEQ ID NO: 49926 - RNA, 16 nt, Homo sapiens
cugagacacaugggug

SEQ ID NO: 49927 - RNA, 20 nt, Homo sapiens
cugagaccaaggcccccggg

SEQ ID NO: 49928 - RNA, 21 nt, Homo sapiens
cugagaccaaggcccccgggc

SEQ ID NO: 49929 - RNA, 22 nt, Homo sapiens
cugagaccaaggcccccgggcc

SEQ ID NO: 49930 - RNA, 19 nt, Homo sapiens
cugagaccagccaaccugg

SEQ ID NO: 49931 - RNA, 20 nt, Homo sapiens
cugagaccagccaaccuggg

SEQ ID NO: 49932 - RNA, 23 nt, Homo sapiens
cugagaccagccaaccugggggc

SEQ ID NO: 49933 - RNA, 18 nt, Homo sapiens
cugagaugugaacacauc

SEQ ID NO: 49934 - RNA, 23 nt, Homo sapiens
cugagaugugaacacaucagcuu

SEQ ID NO: 49935 - RNA, 16 nt, Homo sapiens
cugagcagauguaaua

SEQ ID NO: 49936 - RNA, 10 nt, Homo sapiens
cugagcaguc

SEQ ID NO: 49937 - RNA, 20 nt, Homo sapiens
cugagcccggaaacuccaca

SEQ ID NO: 49938 - RNA, 20 nt, Homo sapiens
cugagcccuacugugucuca

SEQ ID NO: 49939 - RNA, 14 nt, Homo sapiens
cugagcgacaguga

SEQ ID NO: 49940 - RNA, 15 nt, Homo sapiens
cugagcgacagugag

SEQ ID NO: 49941 - RNA, 18 nt, Homo sapiens
cugagcggaccuucccag

SEQ ID NO: 49942 - RNA, 22 nt, Homo sapiens
cugaggcaagagaauugcuuga

SEQ ID NO: 49943 - RNA, 12 nt, Homo sapiens
cugaggcgggug

SEQ ID NO: 49944 - RNA, 13 nt, Homo sapiens
cugaggcgggugg

SEQ ID NO: 49945 - RNA, 17 nt, Homo sapiens
cugaguacguugugcau

SEQ ID NO: 49946 - RNA, 21 nt, Homo sapiens
cugaguguugccuaauuuguu

SEQ ID NO: 49947 - RNA, 20 nt, Homo sapiens
cugauaaagaugagugagca

SEQ ID NO: 49948 - RNA, 16 nt, Homo sapiens
cugauacccuuugaaa

SEQ ID NO: 49949 - RNA, 14 nt, Homo sapiens
cugauguaaguaaa

SEQ ID NO: 49950 - RNA, 16 nt, Homo sapiens
cugauuuuccuggaca

SEQ ID NO: 49951 - RNA, 23 nt, Homo sapiens
cugcaacaugccagccacuguga

SEQ ID NO: 49952 - RNA, 11 nt, Homo sapiens
cugcaaccugu

SEQ ID NO: 49953 - RNA, 20 nt, Homo sapiens
cugcaacuacuauccaacuu

SEQ ID NO: 49954 - RNA, 13 nt, Homo sapiens
cugcaacucugaa

SEQ ID NO: 49955 - RNA, 17 nt, Homo sapiens
cugcaacucugaagggu

SEQ ID NO: 49956 - RNA, 15 nt, Homo sapiens
cugcaagcuuuucaa

SEQ ID NO: 49957 - RNA, 19 nt, Homo sapiens
cugcaaucugagccagugc

SEQ ID NO: 49958 - RNA, 15 nt, Homo sapiens
cugcaaucuucucag

SEQ ID NO: 49959 - RNA, 23 nt, Homo sapiens
cugcaaucuucucagaaggcaaa

SEQ ID NO: 49960 - RNA, 13 nt, Homo sapiens
cugcaauuccacu

SEQ ID NO: 49961 - RNA, 12 nt, Homo sapiens
cugcacacuguc

SEQ ID NO: 49962 - RNA, 22 nt, Homo sapiens
cugcacaucaaaauaugcccca

SEQ ID NO: 49963 - RNA, 19 nt, Homo sapiens
cugcacuccagccugagcg

SEQ ID NO: 49964 - RNA, 17 nt, Homo sapiens
cugcacugucaagauga

SEQ ID NO: 49965 - RNA, 14 nt, Homo sapiens
cugcagacaugaga

SEQ ID NO: 49966 - RNA, 21 nt, Homo sapiens
cugcagacaugagagacagca

SEQ ID NO: 49967 - RNA, 18 nt, Homo sapiens
cugcagccccugggacca

SEQ ID NO: 49968 - RNA, 19 nt, Homo sapiens
cugcagccccugggaccag

SEQ ID NO: 49969 - RNA, 18 nt, Homo sapiens
cugcagcgaguacuuccc

SEQ ID NO: 49970 - RNA, 20 nt, Homo sapiens
cugcagcgaguacuucccgc

SEQ ID NO: 49971 - RNA, 22 nt, Homo sapiens
cugcagcgaguacuucccgcug

SEQ ID NO: 49972 - RNA, 22 nt, Homo sapiens
cugcaggcgugaccugacagcc

SEQ ID NO: 49973 - RNA, 22 nt, Homo sapiens
cugcauacucauuaggauggcu

SEQ ID NO: 49974 - RNA, 11 nt, Homo sapiens
cugcaucagcu

SEQ ID NO: 49975 - RNA, 18 nt, Homo sapiens
cugccaauauccuaauaa

SEQ ID NO: 49976 - RNA, 15 nt, Homo sapiens
cugccaucauuuacu

SEQ ID NO: 49977 - RNA, 15 nt, Homo sapiens
cugccaugcucucca

SEQ ID NO: 49978 - RNA, 11 nt, Homo sapiens
cugccccgggg

SEQ ID NO: 49979 - RNA, 22 nt, Homo sapiens
cugccccggggaggggcgcucg

SEQ ID NO: 49980 - RNA, 23 nt, Homo sapiens
cugccccggggaggggcgcucgc

SEQ ID NO: 49981 - RNA, 24 nt, Homo sapiens
cugccccggggaggggcgcucgcu

SEQ ID NO: 49982 - RNA, 13 nt, Homo sapiens
cugccccugagcc

SEQ ID NO: 49983 - RNA, 16 nt, Homo sapiens
cugccccugagcccau

SEQ ID NO: 49984 - RNA, 17 nt, Homo sapiens
cugcccuuccccuuccc

SEQ ID NO: 49985 - RNA, 23 nt, Homo sapiens
cugccgguuugaaaauaugccug

SEQ ID NO: 49986 - RNA, 13 nt, Homo sapiens
cugccgugggccu

SEQ ID NO: 49987 - RNA, 17 nt, Homo sapiens
cugccuaagugcagccc

SEQ ID NO: 49988 - RNA, 22 nt, Homo sapiens
cugccuaagugcagccccgugg

SEQ ID NO: 49989 - RNA, 12 nt, Homo sapiens
cugccucaauca

SEQ ID NO: 49990 - RNA, 13 nt, Homo sapiens
cugccucaaucag

SEQ ID NO: 49991 - RNA, 13 nt, Homo sapiens
cugccucaccucu

SEQ ID NO: 49992 - RNA, 23 nt, Homo sapiens
cugccucaccucucaccucccaa

SEQ ID NO: 49993 - RNA, 18 nt, Homo sapiens
cugccuccccagcucuau

SEQ ID NO: 49994 - RNA, 14 nt, Homo sapiens
cugccugcccugaa

SEQ ID NO: 49995 - RNA, 15 nt, Homo sapiens
cugccugcccugaaa

SEQ ID NO: 49996 - RNA, 20 nt, Homo sapiens
cugccuggacuuggccccug

SEQ ID NO: 49997 - RNA, 19 nt, Homo sapiens
cugccuugguauagcauau

SEQ ID NO: 49998 - RNA, 21 nt, Homo sapiens
cugccuuguuuaauguuaauu

SEQ ID NO: 49999 - RNA, 12 nt, Homo sapiens
cugcgcgccgcg

SEQ ID NO: 50000 - RNA, 14 nt, Homo sapiens
cugcgcgccgcgcu

SEQ ID NO: 50001 - RNA, 16 nt, Homo sapiens
cugcgcgccgcgcucc

SEQ ID NO: 50002 - RNA, 20 nt, Homo sapiens
cugcgcgccgcgcuccucgg

SEQ ID NO: 50003 - RNA, 12 nt, Homo sapiens
cugcgcucggcc

SEQ ID NO: 50004 - RNA, 14 nt, Homo sapiens
cugcgcucggccug

SEQ ID NO: 50005 - RNA, 15 nt, Homo sapiens
cugcgcucggccugc

SEQ ID NO: 50006 - RNA, 18 nt, Homo sapiens
cugcgcucggccugcucg

SEQ ID NO: 50007 - RNA, 19 nt, Homo sapiens
cugcgcucggccugcucgc

SEQ ID NO: 50008 - RNA, 21 nt, Homo sapiens
cugcuacucuguuccuucaca

SEQ ID NO: 50009 - RNA, 22 nt, Homo sapiens
cugcuaugcuauugaaguuuug

SEQ ID NO: 50010 - RNA, 17 nt, Homo sapiens
cugcuauuugcuguuau

SEQ ID NO: 50011 - RNA, 18 nt, Homo sapiens
cugcuauuugcuguuauu

SEQ ID NO: 50012 - RNA, 19 nt, Homo sapiens
cugcuauuugcuguuauuu

SEQ ID NO: 50013 - RNA, 19 nt, Homo sapiens
cugcucgcccacuuccucc

SEQ ID NO: 50014 - RNA, 14 nt, Homo sapiens
cugcugcccuuccc

SEQ ID NO: 50015 - RNA, 14 nt, Homo sapiens
cugcugccgugggc

SEQ ID NO: 50016 - RNA, 15 nt, Homo sapiens
cugcugccgugggcc

SEQ ID NO: 50017 - RNA, 18 nt, Homo sapiens
cugcugccgugggccuga

SEQ ID NO: 50018 - RNA, 21 nt, Homo sapiens
cugcuggauguggagggggcg

SEQ ID NO: 50019 - RNA, 19 nt, Homo sapiens
cugcuggauucaagugauc

SEQ ID NO: 50020 - RNA, 13 nt, Homo sapiens
cugcugguggcgc

SEQ ID NO: 50021 - RNA, 16 nt, Homo sapiens
cugcugguggcgcugg

SEQ ID NO: 50022 - RNA, 19 nt, Homo sapiens
cugcugguggcgcuggcug

SEQ ID NO: 50023 - RNA, 24 nt, Homo sapiens
cugcugguggcgcuggcugcgcuc

SEQ ID NO: 50024 - RNA, 17 nt, Homo sapiens
cugcuguuuccuagcgc

SEQ ID NO: 50025 - RNA, 18 nt, Homo sapiens
cugcuguuuccuagcgca

SEQ ID NO: 50026 - RNA, 20 nt, Homo sapiens
cugcuguuuccuagcgcagc

SEQ ID NO: 50027 - RNA, 21 nt, Homo sapiens
cugcuguuuccuagcgcagcc

SEQ ID NO: 50028 - RNA, 14 nt, Homo sapiens
cugcuuuaauuuca

SEQ ID NO: 50029 - RNA, 14 nt, Homo sapiens
cugcuuucaucuug

SEQ ID NO: 50030 - RNA, 22 nt, Homo sapiens
cuggaaaccacauggcuucacc

SEQ ID NO: 50031 - RNA, 15 nt, Homo sapiens
cuggaacucucgagc

SEQ ID NO: 50032 - RNA, 16 nt, Homo sapiens
cuggaacucucgagcg

SEQ ID NO: 50033 - RNA, 13 nt, Homo sapiens
cuggaagccucua

SEQ ID NO: 50034 - RNA, 19 nt, Homo sapiens
cuggaagccucuauugcca

SEQ ID NO: 50035 - RNA, 23 nt, Homo sapiens
cuggaagccucuauugccaugag

SEQ ID NO: 50036 - RNA, 17 nt, Homo sapiens
cuggacuuuccagagac

SEQ ID NO: 50037 - RNA, 18 nt, Homo sapiens
cuggacuuuccagagacc

SEQ ID NO: 50038 - RNA, 16 nt, Homo sapiens
cuggagugcaguggcg

SEQ ID NO: 50039 - RNA, 18 nt, Homo sapiens
cuggagugcaguggcgca

SEQ ID NO: 50040 - RNA, 20 nt, Homo sapiens
cuggagugcaguggcgcaau

SEQ ID NO: 50041 - RNA, 19 nt, Homo sapiens
cuggaucucacaagcacuu

SEQ ID NO: 50042 - RNA, 20 nt, Homo sapiens
cuggaucucacaagcacuuu

SEQ ID NO: 50043 - RNA, 20 nt, Homo sapiens
cuggauugcgccuaaugugu

SEQ ID NO: 50044 - RNA, 15 nt, Homo sapiens
cuggcacaguuuucu

SEQ ID NO: 50045 - RNA, 21 nt, Homo sapiens
cuggcaccgcuguacgcgagc

SEQ ID NO: 50046 - RNA, 16 nt, Homo sapiens
cuggcacuugggacaa

SEQ ID NO: 50047 - RNA, 17 nt, Homo sapiens
cuggcacuugggacaaa

SEQ ID NO: 50048 - RNA, 16 nt, Homo sapiens
cuggccaacgggguga

SEQ ID NO: 50049 - RNA, 18 nt, Homo sapiens
cuggccaggcuggucucg

SEQ ID NO: 50050 - RNA, 13 nt, Homo sapiens
cuggccugcugga

SEQ ID NO: 50051 - RNA, 14 nt, Homo sapiens
cuggccugcuggau

SEQ ID NO: 50052 - RNA, 15 nt, Homo sapiens
cuggccugcuggaug

SEQ ID NO: 50053 - RNA, 20 nt, Homo sapiens
cuggcgacaguuuuccuucu

SEQ ID NO: 50054 - RNA, 21 nt, Homo sapiens
cuggcucccuggaagagauca

SEQ ID NO: 50055 - RNA, 12 nt, Homo sapiens
cuggcugcgcuc

SEQ ID NO: 50056 - RNA, 15 nt, Homo sapiens
cuggcugcgcucggc

SEQ ID NO: 50057 - RNA, 22 nt, Homo sapiens
cuggcugcgcucggccugcucg

SEQ ID NO: 50058 - RNA, 23 nt, Homo sapiens
cuggcugcgcucggccugcucgc

SEQ ID NO: 50059 - RNA, 24 nt, Homo sapiens
cuggcugcgcucggccugcucgcc

SEQ ID NO: 50060 - RNA, 14 nt, Homo sapiens
cuggcugcuggugg

SEQ ID NO: 50061 - RNA, 16 nt, Homo sapiens
cuggcugcugguggcg

SEQ ID NO: 50062 - RNA, 18 nt, Homo sapiens
cuggcugcugguggcgcu

SEQ ID NO: 50063 - RNA, 20 nt, Homo sapiens
cuggcugcugguggcgcugg

SEQ ID NO: 50064 - RNA, 23 nt, Homo sapiens
cuggcugggaguggcauguauga

SEQ ID NO: 50065 - RNA, 15 nt, Homo sapiens
cuggcuggggccugu

SEQ ID NO: 50066 - RNA, 19 nt, Homo sapiens
cugggaauuacaggcguga

SEQ ID NO: 50067 - RNA, 20 nt, Homo sapiens
cugggaauuacaggcgugag

SEQ ID NO: 50068 - RNA, 22 nt, Homo sapiens
cugggaauuacaggcgugagcc

SEQ ID NO: 50069 - RNA, 11 nt, Homo sapiens
cugggacaggg

SEQ ID NO: 50070 - RNA, 15 nt, Homo sapiens
cugggagccccaauu

SEQ ID NO: 50071 - RNA, 19 nt, Homo sapiens
cugggauagcugacccagc

SEQ ID NO: 50072 - RNA, 14 nt, Homo sapiens
cuggggcucuggga

SEQ ID NO: 50073 - RNA, 20 nt, Homo sapiens
cuggggcucugggauagcug

SEQ ID NO: 50074 - RNA, 21 nt, Homo sapiens
cugggguggguggggcagugc

SEQ ID NO: 50075 - RNA, 13 nt, Homo sapiens
cugggucgccggc

SEQ ID NO: 50076 - RNA, 14 nt, Homo sapiens
cugggucgccggca

SEQ ID NO: 50077 - RNA, 17 nt, Homo sapiens
cugggucucaguguccu

SEQ ID NO: 50078 - RNA, 16 nt, Homo sapiens
cuggguuccugcaaug

SEQ ID NO: 50079 - RNA, 15 nt, Homo sapiens
cugguaacauagguu

SEQ ID NO: 50080 - RNA, 21 nt, Homo sapiens
cugguccuaagucccugcugc

SEQ ID NO: 50081 - RNA, 22 nt, Homo sapiens
cuggucuaccuguucgcgcgcc

SEQ ID NO: 50082 - RNA, 18 nt, Homo sapiens
cuggucucgaacugcugg

SEQ ID NO: 50083 - RNA, 12 nt, Homo sapiens
cugguggcgcug

SEQ ID NO: 50084 - RNA, 14 nt, Homo sapiens
cugguggcgcuggc

SEQ ID NO: 50085 - RNA, 16 nt, Homo sapiens
cugguggcgcuggcug

SEQ ID NO: 50086 - RNA, 18 nt, Homo sapiens
cugguggcgcuggcugcg

SEQ ID NO: 50087 - RNA, 19 nt, Homo sapiens
cugguggcgcuggcugcgc

SEQ ID NO: 50088 - RNA, 22 nt, Homo sapiens
cugguggcgcuggcugcgcucg

SEQ ID NO: 50089 - RNA, 15 nt, Homo sapiens
cugguucuucuuggu

SEQ ID NO: 50090 - RNA, 17 nt, Homo sapiens
cuguaaaauggagacac

SEQ ID NO: 50091 - RNA, 19 nt, Homo sapiens
cuguaaaauggagacacca

SEQ ID NO: 50092 - RNA, 22 nt, Homo sapiens
cuguaaaauggagacaccacca

SEQ ID NO: 50093 - RNA, 24 nt, Homo sapiens
cuguaaaauggagacaccaccacc

SEQ ID NO: 50094 - RNA, 20 nt, Homo sapiens
cuguaaagcuuugugcagau

SEQ ID NO: 50095 - RNA, 12 nt, Homo sapiens
cuguaagaaaau

SEQ ID NO: 50096 - RNA, 17 nt, Homo sapiens
cuguaaucccagcacuu

SEQ ID NO: 50097 - RNA, 21 nt, Homo sapiens
cuguaaucccagcacuuuggg

SEQ ID NO: 50098 - RNA, 18 nt, Homo sapiens
cuguaaucccagcuacuu

SEQ ID NO: 50099 - RNA, 21 nt, Homo sapiens
cuguaaucccagcuacuuggg

SEQ ID NO: 50100 - RNA, 17 nt, Homo sapiens
cuguaauuugugauaca

SEQ ID NO: 50101 - RNA, 18 nt, Homo sapiens
cuguacaugaaaacacau

SEQ ID NO: 50102 - RNA, 16 nt, Homo sapiens
cuguacgcgagcgcgc

SEQ ID NO: 50103 - RNA, 17 nt, Homo sapiens
cuguacgcgagcgcgcg

SEQ ID NO: 50104 - RNA, 20 nt, Homo sapiens
cuguacgcgagcgcgcgcgc

SEQ ID NO: 50105 - RNA, 23 nt, Homo sapiens
cuguacgcgagcgcgcgcgcccu

SEQ ID NO: 50106 - RNA, 15 nt, Homo sapiens
cuguacuuuuuccag

SEQ ID NO: 50107 - RNA, 22 nt, Homo sapiens
cuguagaaaagggaacugaaca

SEQ ID NO: 50108 - RNA, 19 nt, Homo sapiens
cuguaucuuguuuuuccac

SEQ ID NO: 50109 - RNA, 14 nt, Homo sapiens
cuguccauucuucc

SEQ ID NO: 50110 - RNA, 23 nt, Homo sapiens
cugucccagcgagggacaccgag

SEQ ID NO: 50111 - RNA, 22 nt, Homo sapiens
cuguccccaucaucacccagca

SEQ ID NO: 50112 - RNA, 17 nt, Homo sapiens
cuguccuauuauauuca

SEQ ID NO: 50113 - RNA, 19 nt, Homo sapiens
cugucuggacuuuccagag

SEQ ID NO: 50114 - RNA, 14 nt, Homo sapiens
cugugauagaggcu

SEQ ID NO: 50115 - RNA, 11 nt, Homo sapiens
cugugcggccu

SEQ ID NO: 50116 - RNA, 13 nt, Homo sapiens
cugugcggccugg

SEQ ID NO: 50117 - RNA, 15 nt, Homo sapiens
cuguggccaaguucu

SEQ ID NO: 50118 - RNA, 19 nt, Homo sapiens
cugugucaguggaugcugc

SEQ ID NO: 50119 - RNA, 16 nt, Homo sapiens
cugugucucaggugug

SEQ ID NO: 50120 - RNA, 22 nt, Homo sapiens
cugugucucaggugugcccuga

SEQ ID NO: 50121 - RNA, 14 nt, Homo sapiens
cuguuaaaagauga

SEQ ID NO: 50122 - RNA, 16 nt, Homo sapiens
cuguuaaaagaugaaa

SEQ ID NO: 50123 - RNA, 17 nt, Homo sapiens
cuguuccucgccacgcu

SEQ ID NO: 50124 - RNA, 22 nt, Homo sapiens
cuguuccucgccacgcucuggg

SEQ ID NO: 50125 - RNA, 14 nt, Homo sapiens
cuguuccuucacau

SEQ ID NO: 50126 - RNA, 13 nt, Homo sapiens
cuguucgcgcgcc

SEQ ID NO: 50127 - RNA, 15 nt, Homo sapiens
cuguucgcgcgccuc

SEQ ID NO: 50128 - RNA, 12 nt, Homo sapiens
cuguucuuucug

SEQ ID NO: 50129 - RNA, 16 nt, Homo sapiens
cuguugccaaggcugg

SEQ ID NO: 50130 - RNA, 18 nt, Homo sapiens
cuguugccaaggcuggag

SEQ ID NO: 50131 - RNA, 21 nt, Homo sapiens
cuguugccaaggcuggagugc

SEQ ID NO: 50132 - RNA, 19 nt, Homo sapiens
cuguuuccauagggugaca

SEQ ID NO: 50133 - RNA, 17 nt, Homo sapiens
cuuaaaaucuaauucaa

SEQ ID NO: 50134 - RNA, 14 nt, Homo sapiens
cuuaaacacuaaaa

SEQ ID NO: 50135 - RNA, 16 nt, Homo sapiens
cuuaaagaauuuucaa

SEQ ID NO: 50136 - RNA, 23 nt, Homo sapiens
cuuaaaggaagguucugguguga

SEQ ID NO: 50137 - RNA, 15 nt, Homo sapiens
cuuaacucauugcaa

SEQ ID NO: 50138 - RNA, 12 nt, Homo sapiens
cuuaagcuuuca

SEQ ID NO: 50139 - RNA, 21 nt, Homo sapiens
cuuaauuauugauguuuucau

SEQ ID NO: 50140 - RNA, 22 nt, Homo sapiens
cuuaauuauugauguuuucaua

SEQ ID NO: 50141 - RNA, 15 nt, Homo sapiens
cuuacaaugcauucu

SEQ ID NO: 50142 - RNA, 13 nt, Homo sapiens
cuuacguccuucc

SEQ ID NO: 50143 - RNA, 21 nt, Homo sapiens
cuuacguccuuccacuuccaa

SEQ ID NO: 50144 - RNA, 19 nt, Homo sapiens
cuuacuaguuucccuugca

SEQ ID NO: 50145 - RNA, 12 nt, Homo sapiens
cuuacucuugau

SEQ ID NO: 50146 - RNA, 18 nt, Homo sapiens
cuuacucuugauuguggg

SEQ ID NO: 50147 - RNA, 21 nt, Homo sapiens
cuuacucuugauugugggaua

SEQ ID NO: 50148 - RNA, 15 nt, Homo sapiens
cuuacuuaguguuau

SEQ ID NO: 50149 - RNA, 12 nt, Homo sapiens
cuuagaacaaag

SEQ ID NO: 50150 - RNA, 20 nt, Homo sapiens
cuuagacccucaugcugcca

SEQ ID NO: 50151 - RNA, 18 nt, Homo sapiens
cuuagggaaggauacaaa

SEQ ID NO: 50152 - RNA, 21 nt, Homo sapiens
cuuaguguacaugaaagcgua

SEQ ID NO: 50153 - RNA, 13 nt, Homo sapiens
cuuauaauagguu

SEQ ID NO: 50154 - RNA, 15 nt, Homo sapiens
cuuaugaaacuaaga

SEQ ID NO: 50155 - RNA, 13 nt, Homo sapiens
cuuaugaaccuuu

SEQ ID NO: 50156 - RNA, 19 nt, Homo sapiens
cuuauuaaaacucauuuuu

SEQ ID NO: 50157 - RNA, 14 nt, Homo sapiens
cuuauuguaccucu

SEQ ID NO: 50158 - RNA, 20 nt, Homo sapiens
cuuauuguagcauccuggaa

SEQ ID NO: 50159 - RNA, 13 nt, Homo sapiens
cuuauuucauuuc

SEQ ID NO: 50160 - RNA, 14 nt, Homo sapiens
cuucacaacagauu

SEQ ID NO: 50161 - RNA, 20 nt, Homo sapiens
cuucagaucucuaacuucac

SEQ ID NO: 50162 - RNA, 15 nt, Homo sapiens
cuucagcgguuuaua

SEQ ID NO: 50163 - RNA, 18 nt, Homo sapiens
cuucagcgguuuauauaa

SEQ ID NO: 50164 - RNA, 16 nt, Homo sapiens
cuucaugcauuugcac

SEQ ID NO: 50165 - RNA, 15 nt, Homo sapiens
cuucauguacaucca

SEQ ID NO: 50166 - RNA, 19 nt, Homo sapiens
cuuccaaacagaacuaugg

SEQ ID NO: 50167 - RNA, 21 nt, Homo sapiens
cuuccagauccuggaaaucag

SEQ ID NO: 50168 - RNA, 15 nt, Homo sapiens
cuuccagggcuacgc

SEQ ID NO: 50169 - RNA, 17 nt, Homo sapiens
cuuccagggcuacgcgc

SEQ ID NO: 50170 - RNA, 19 nt, Homo sapiens
cuuccagggcuacgcgcgc

SEQ ID NO: 50171 - RNA, 20 nt, Homo sapiens
cuuccagggcuacgcgcgcu

SEQ ID NO: 50172 - RNA, 21 nt, Homo sapiens
cuuccagggcuacgcgcgcuc

SEQ ID NO: 50173 - RNA, 22 nt, Homo sapiens
cuuccagggcuacgcgcgcucc

SEQ ID NO: 50174 - RNA, 24 nt, Homo sapiens
cuuccagggcuacgcgcgcuccgc

SEQ ID NO: 50175 - RNA, 20 nt, Homo sapiens
cuucccagcuagaauucacu

SEQ ID NO: 50176 - RNA, 12 nt, Homo sapiens
cuucccgcuguu

SEQ ID NO: 50177 - RNA, 14 nt, Homo sapiens
cuucccgcuguucc

SEQ ID NO: 50178 - RNA, 15 nt, Homo sapiens
cuucccgcuguuccu

SEQ ID NO: 50179 - RNA, 23 nt, Homo sapiens
cuucccuuuuacauacugcuguc

SEQ ID NO: 50180 - RNA, 15 nt, Homo sapiens
cuuccgcauccuagu

SEQ ID NO: 50181 - RNA, 17 nt, Homo sapiens
cuuccgcauccuagucu

SEQ ID NO: 50182 - RNA, 16 nt, Homo sapiens
cuuccuauaauuuuag

SEQ ID NO: 50183 - RNA, 16 nt, Homo sapiens
cuuccucagcuguaga

SEQ ID NO: 50184 - RNA, 14 nt, Homo sapiens
cuuccucccggccg

SEQ ID NO: 50185 - RNA, 15 nt, Homo sapiens
cuuccucccggccgc

SEQ ID NO: 50186 - RNA, 16 nt, Homo sapiens
cuuccucccggccgcg

SEQ ID NO: 50187 - RNA, 17 nt, Homo sapiens
cuuccucccggccgcgc

SEQ ID NO: 50188 - RNA, 18 nt, Homo sapiens
cuuccucccggccgcgcu

SEQ ID NO: 50189 - RNA, 19 nt, Homo sapiens
cuuccucccggccgcgcug

SEQ ID NO: 50190 - RNA, 18 nt, Homo sapiens
cuuccuggcaauagucaa

SEQ ID NO: 50191 - RNA, 21 nt, Homo sapiens
cuucuaaguaaaaccacagca

SEQ ID NO: 50192 - RNA, 17 nt, Homo sapiens
cuucucauacuauuuaa

SEQ ID NO: 50193 - RNA, 20 nt, Homo sapiens
cuucucaucugugauucccu

SEQ ID NO: 50194 - RNA, 17 nt, Homo sapiens
cuucucuucacagucac

SEQ ID NO: 50195 - RNA, 21 nt, Homo sapiens
cuucugacacuaaaacaccuc

SEQ ID NO: 50196 - RNA, 13 nt, Homo sapiens
cuucuguuuuaua

SEQ ID NO: 50197 - RNA, 20 nt, Homo sapiens
cuucuguuuuauaauuuugu

SEQ ID NO: 50198 - RNA, 16 nt, Homo sapiens
cuucuuacaaugcauu

SEQ ID NO: 50199 - RNA, 15 nt, Homo sapiens
cuucuuggucucagu

SEQ ID NO: 50200 - RNA, 19 nt, Homo sapiens
cuucuuggucucaguguca

SEQ ID NO: 50201 - RNA, 16 nt, Homo sapiens
cuucuugguucugaaa

SEQ ID NO: 50202 - RNA, 16 nt, Homo sapiens
cuucuuucaugaaggg

SEQ ID NO: 50203 - RNA, 20 nt, Homo sapiens
cuucuuucaugaaggggcgg

SEQ ID NO: 50204 - RNA, 21 nt, Homo sapiens
cuugaaauagugucugaugaa

SEQ ID NO: 50205 - RNA, 15 nt, Homo sapiens
cuugaacccgggagg

SEQ ID NO: 50206 - RNA, 13 nt, Homo sapiens
cuugaauuguagg

SEQ ID NO: 50207 - RNA, 21 nt, Homo sapiens
cuugagaaaccuuauuguacc

SEQ ID NO: 50208 - RNA, 13 nt, Homo sapiens
cuugaugaagaag

SEQ ID NO: 50209 - RNA, 14 nt, Homo sapiens
cuugaugaagaagu

SEQ ID NO: 50210 - RNA, 20 nt, Homo sapiens
cuugaugauacaaugaacac

SEQ ID NO: 50211 - RNA, 23 nt, Homo sapiens
cuugccauggagguuaagcacuu

SEQ ID NO: 50212 - RNA, 15 nt, Homo sapiens
cuuggacucauuuua

SEQ ID NO: 50213 - RNA, 15 nt, Homo sapiens
cuuggauucaauuuu

SEQ ID NO: 50214 - RNA, 12 nt, Homo sapiens
cuuggcccagga

SEQ ID NO: 50215 - RNA, 19 nt, Homo sapiens
cuuggcccaggaguuuggc

SEQ ID NO: 50216 - RNA, 22 nt, Homo sapiens
cuugggacaaaaacaaacaaac

SEQ ID NO: 50217 - RNA, 15 nt, Homo sapiens
cuugggcaggucaca

SEQ ID NO: 50218 - RNA, 15 nt, Homo sapiens
cuugggcgggacaca

SEQ ID NO: 50219 - RNA, 14 nt, Homo sapiens
cuuggucucagugu

SEQ ID NO: 50220 - RNA, 19 nt, Homo sapiens
cuuguaaggcauacugccu

SEQ ID NO: 50221 - RNA, 21 nt, Homo sapiens
cuuguacauaaugcgugcaua

SEQ ID NO: 50222 - RNA, 13 nt, Homo sapiens
cuuguacucuaca

SEQ ID NO: 50223 - RNA, 20 nt, Homo sapiens
cuuguagcucucugaccucc

SEQ ID NO: 50224 - RNA, 18 nt, Homo sapiens
cuugucaauaaaauccau

SEQ ID NO: 50225 - RNA, 13 nt, Homo sapiens
cuugucucugggc

SEQ ID NO: 50226 - RNA, 17 nt, Homo sapiens
cuugugugcacauaucc

SEQ ID NO: 50227 - RNA, 20 nt, Homo sapiens
cuuguugagauccccguguu

SEQ ID NO: 50228 - RNA, 21 nt, Homo sapiens
cuuguuggauuuuugucuugu

SEQ ID NO: 50229 - RNA, 21 nt, Homo sapiens
cuuguuuuuccacuacugcua

SEQ ID NO: 50230 - RNA, 24 nt, Homo sapiens
cuuuaaaaaaaaaaaaaaagccaa

SEQ ID NO: 50231 - RNA, 15 nt, Homo sapiens
cuuuaaaacuuaucc

SEQ ID NO: 50232 - RNA, 20 nt, Homo sapiens
cuuuaaguguaacuggcagu

SEQ ID NO: 50233 - RNA, 22 nt, Homo sapiens
cuuuaauuucaugaaaagauua

SEQ ID NO: 50234 - RNA, 22 nt, Homo sapiens
cuuuaccuuuuuuauacauaaa

SEQ ID NO: 50235 - RNA, 15 nt, Homo sapiens
cuuuagggaccugcu

SEQ ID NO: 50236 - RNA, 16 nt, Homo sapiens
cuuuagggaccugcug

SEQ ID NO: 50237 - RNA, 22 nt, Homo sapiens
cuuuaguuuuugugaaguuuaa

SEQ ID NO: 50238 - RNA, 11 nt, Homo sapiens
cuuuaucucag

SEQ ID NO: 50239 - RNA, 20 nt, Homo sapiens
cuuucaagggaccucuccau

SEQ ID NO: 50240 - RNA, 23 nt, Homo sapiens
cuuucaagggaccucuccaugau

SEQ ID NO: 50241 - RNA, 17 nt, Homo sapiens
cuuucacaggggacagg

SEQ ID NO: 50242 - RNA, 15 nt, Homo sapiens
cuuucauauuuuagc

SEQ ID NO: 50243 - RNA, 19 nt, Homo sapiens
cuuucaugaaggggcggcg

SEQ ID NO: 50244 - RNA, 22 nt, Homo sapiens
cuuucaugaaggggcggcggcc

SEQ ID NO: 50245 - RNA, 15 nt, Homo sapiens
cuuuccagagaccag

SEQ ID NO: 50246 - RNA, 20 nt, Homo sapiens
cuuuccagagaccaguauuc

SEQ ID NO: 50247 - RNA, 23 nt, Homo sapiens
cuuucucuaguucaaguucacca

SEQ ID NO: 50248 - RNA, 20 nt, Homo sapiens
cuuugaugauuaauucaccu

SEQ ID NO: 50249 - RNA, 21 nt, Homo sapiens
cuuugaugauuaauucaccuu

SEQ ID NO: 50250 - RNA, 18 nt, Homo sapiens
cuuugauuuuauaugcua

SEQ ID NO: 50251 - RNA, 19 nt, Homo sapiens
cuuugugcagauucuuuac

SEQ ID NO: 50252 - RNA, 18 nt, Homo sapiens
cuuuuaaaaaaaaauacu

SEQ ID NO: 50253 - RNA, 15 nt, Homo sapiens
cuuuuaaacuuugau

SEQ ID NO: 50254 - RNA, 16 nt, Homo sapiens
cuuuuacauacugcug

SEQ ID NO: 50255 - RNA, 20 nt, Homo sapiens
cuuuuauaaacuuuaccuuu

SEQ ID NO: 50256 - RNA, 15 nt, Homo sapiens
cuuuuauugccauga

SEQ ID NO: 50257 - RNA, 19 nt, Homo sapiens
cuuuucaaaauuggacuua

SEQ ID NO: 50258 - RNA, 20 nt, Homo sapiens
cuuuugauaaucaacugggc

SEQ ID NO: 50259 - RNA, 22 nt, Homo sapiens
cuuuuggcuuguaaaguacaga

SEQ ID NO: 50260 - RNA, 22 nt, Homo sapiens
cuuuuuagagaaauuugccaau

SEQ ID NO: 50261 - RNA, 19 nt, Homo sapiens
cuuuuuccagguuccugag

SEQ ID NO: 50262 - RNA, 19 nt, Homo sapiens
cuuuuuuagaguugauacu

SEQ ID NO: 50263 - RNA, 18 nt, Homo sapiens
cuuuuuuuuaaguuacac

SEQ ID NO: 50264 - RNA, 19 nt, Homo sapiens
gaaaaaguucugcagauaa

SEQ ID NO: 50265 - RNA, 13 nt, Homo sapiens
gaaaacaaggaug

SEQ ID NO: 50266 - RNA, 18 nt, Homo sapiens
gaaaacacauuuuucuua

SEQ ID NO: 50267 - RNA, 13 nt, Homo sapiens
gaaaacaggcaaa

SEQ ID NO: 50268 - RNA, 20 nt, Homo sapiens
gaaaacauagcaucucagga

SEQ ID NO: 50269 - RNA, 21 nt, Homo sapiens
gaaaacaugcuacacacugca

SEQ ID NO: 50270 - RNA, 20 nt, Homo sapiens
gaaaagacauaagcaaagac

SEQ ID NO: 50271 - RNA, 20 nt, Homo sapiens
gaaaaguuucccagucuuca

SEQ ID NO: 50272 - RNA, 17 nt, Homo sapiens
gaaaauaaaagcacuua

SEQ ID NO: 50273 - RNA, 16 nt, Homo sapiens
gaaaauaaaauauuua

SEQ ID NO: 50274 - RNA, 18 nt, Homo sapiens
gaaaauaaaauauuuaaa

SEQ ID NO: 50275 - RNA, 20 nt, Homo sapiens
gaaaaucuacacuccaguga

SEQ ID NO: 50276 - RNA, 12 nt, Homo sapiens
gaaaaugugcaa

SEQ ID NO: 50277 - RNA, 15 nt, Homo sapiens
gaaaaugugcaauau

SEQ ID NO: 50278 - RNA, 19 nt, Homo sapiens
gaaacaagucagucauuca

SEQ ID NO: 50279 - RNA, 20 nt, Homo sapiens
gaaaccuuauuguaccucuc

SEQ ID NO: 50280 - RNA, 23 nt, Homo sapiens
gaaacguauucaaacaauuugaa

SEQ ID NO: 50281 - RNA, 19 nt, Homo sapiens
gaaacuccacauccugugg

SEQ ID NO: 50282 - RNA, 22 nt, Homo sapiens
gaaagaaaaucaggcuggccaa

SEQ ID NO: 50283 - RNA, 17 nt, Homo sapiens
gaaagaagagccggagc

SEQ ID NO: 50284 - RNA, 13 nt, Homo sapiens
gaaagaagcccaa

SEQ ID NO: 50285 - RNA, 15 nt, Homo sapiens
gaaagagaacuucca

SEQ ID NO: 50286 - RNA, 14 nt, Homo sapiens
gaaagaggaaugaa

SEQ ID NO: 50287 - RNA, 13 nt, Homo sapiens
gaaagauucaaug

SEQ ID NO: 50288 - RNA, 17 nt, Homo sapiens
gaaagcagggacuugaa

SEQ ID NO: 50289 - RNA, 18 nt, Homo sapiens
gaaagcagggacuugaac

SEQ ID NO: 50290 - RNA, 16 nt, Homo sapiens
gaaagcugaguguuuc

SEQ ID NO: 50291 - RNA, 20 nt, Homo sapiens
gaaaggagaaguuaagcaac

SEQ ID NO: 50292 - RNA, 16 nt, Homo sapiens
gaaaggcauucucuga

SEQ ID NO: 50293 - RNA, 23 nt, Homo sapiens
gaaagggcuguuauaaucuuuca

SEQ ID NO: 50294 - RNA, 14 nt, Homo sapiens
gaaagggucucccu

SEQ ID NO: 50295 - RNA, 16 nt, Homo sapiens
gaaagggucucccucu

SEQ ID NO: 50296 - RNA, 22 nt, Homo sapiens
gaaagggucucccucuguugcc

SEQ ID NO: 50297 - RNA, 14 nt, Homo sapiens
gaaagguacuucaa

SEQ ID NO: 50298 - RNA, 15 nt, Homo sapiens
gaaagucccagauca

SEQ ID NO: 50299 - RNA, 17 nt, Homo sapiens
gaaagugacaagcucac

SEQ ID NO: 50300 - RNA, 14 nt, Homo sapiens
gaaaguuuuggaaa

SEQ ID NO: 50301 - RNA, 13 nt, Homo sapiens
gaaauaagccaga

SEQ ID NO: 50302 - RNA, 17 nt, Homo sapiens
gaaauaagccagacauc

SEQ ID NO: 50303 - RNA, 19 nt, Homo sapiens
gaaauaggaaauauuuuaa

SEQ ID NO: 50304 - RNA, 13 nt, Homo sapiens
gaaauagugucug

SEQ ID NO: 50305 - RNA, 14 nt, Homo sapiens
gaaauagugucuga

SEQ ID NO: 50306 - RNA, 16 nt, Homo sapiens
gaaauauuauguuaaa

SEQ ID NO: 50307 - RNA, 11 nt, Homo sapiens
gaaauauuccu

SEQ ID NO: 50308 - RNA, 16 nt, Homo sapiens
gaaauauuuauuuuaa

SEQ ID NO: 50309 - RNA, 20 nt, Homo sapiens
gaaauauuuauuuuaauaau

SEQ ID NO: 50310 - RNA, 21 nt, Homo sapiens
gaaaucaaauaugcaaagcac

SEQ ID NO: 50311 - RNA, 19 nt, Homo sapiens
gaaaugacuaaaaaacaaa

SEQ ID NO: 50312 - RNA, 14 nt, Homo sapiens
gaaaugauuucaca

SEQ ID NO: 50313 - RNA, 23 nt, Homo sapiens
gaaaugcugguuuuucaguuuuc

SEQ ID NO: 50314 - RNA, 13 nt, Homo sapiens
gaaauuaaccaua

SEQ ID NO: 50315 - RNA, 14 nt, Homo sapiens
gaaauuaaguaucu

SEQ ID NO: 50316 - RNA, 20 nt, Homo sapiens
gaaauuuaauucauguuucu

SEQ ID NO: 50317 - RNA, 18 nt, Homo sapiens
gaacaaauuuacagagac

SEQ ID NO: 50318 - RNA, 13 nt, Homo sapiens
gaacagaagagga

SEQ ID NO: 50319 - RNA, 17 nt, Homo sapiens
gaacaggauauucucac

SEQ ID NO: 50320 - RNA, 18 nt, Homo sapiens
gaacagugauuaccaggg

SEQ ID NO: 50321 - RNA, 18 nt, Homo sapiens
gaacaguuaccucugccu

SEQ ID NO: 50322 - RNA, 14 nt, Homo sapiens
gaacaugagccuuu

SEQ ID NO: 50323 - RNA, 21 nt, Homo sapiens
gaacaugagccuuuguugcua

SEQ ID NO: 50324 - RNA, 23 nt, Homo sapiens
gaacccauauuuguacaccaaua

SEQ ID NO: 50325 - RNA, 19 nt, Homo sapiens
gaaccguuugugauugcca

SEQ ID NO: 50326 - RNA, 17 nt, Homo sapiens
gaacgguaaauuucugu

SEQ ID NO: 50327 - RNA, 19 nt, Homo sapiens
gaacguuuuuccuguucuu

SEQ ID NO: 50328 - RNA, 20 nt, Homo sapiens
gaacguuuuuccuguucuua

SEQ ID NO: 50329 - RNA, 23 nt, Homo sapiens
gaacucaaauacgugggcauuca

SEQ ID NO: 50330 - RNA, 24 nt, Homo sapiens
gaacucaaauacgugggcauucaa

SEQ ID NO: 50331 - RNA, 13 nt, Homo sapiens
gaacucucgagcg

SEQ ID NO: 50332 - RNA, 14 nt, Homo sapiens
gaacugaaaucaua

SEQ ID NO: 50333 - RNA, 16 nt, Homo sapiens
gaacugaacauuccag

SEQ ID NO: 50334 - RNA, 11 nt, Homo sapiens
gaacugcugga

SEQ ID NO: 50335 - RNA, 14 nt, Homo sapiens
gaacugcuggauuc

SEQ ID NO: 50336 - RNA, 21 nt, Homo sapiens
gaacugcuggauucaagugau

SEQ ID NO: 50337 - RNA, 19 nt, Homo sapiens
gaacuuguugagauccccg

SEQ ID NO: 50338 - RNA, 17 nt, Homo sapiens
gaacuuuuuguuuuguu

SEQ ID NO: 50339 - RNA, 19 nt, Homo sapiens
gaagaaauuccaggaaaau

SEQ ID NO: 50340 - RNA, 11 nt, Homo sapiens
gaagaacugaa

SEQ ID NO: 50341 - RNA, 12 nt, Homo sapiens
gaagaacugaaa

SEQ ID NO: 50342 - RNA, 16 nt, Homo sapiens
gaagaagcaccaauca

SEQ ID NO: 50343 - RNA, 12 nt, Homo sapiens
gaagaaugacua

SEQ ID NO: 50344 - RNA, 20 nt, Homo sapiens
gaagacaaugacuuacugua

SEQ ID NO: 50345 - RNA, 20 nt, Homo sapiens
gaagagaauauuagcuuuac

SEQ ID NO: 50346 - RNA, 12 nt, Homo sapiens
gaagagccggag

SEQ ID NO: 50347 - RNA, 14 nt, Homo sapiens
gaagagccggagcc

SEQ ID NO: 50348 - RNA, 18 nt, Homo sapiens
gaagagccggagccucca

SEQ ID NO: 50349 - RNA, 19 nt, Homo sapiens
gaagagccggagccuccag

SEQ ID NO: 50350 - RNA, 21 nt, Homo sapiens
gaagagccggagccuccagcu

SEQ ID NO: 50351 - RNA, 22 nt, Homo sapiens
gaagagccggagccuccagcug

SEQ ID NO: 50352 - RNA, 20 nt, Homo sapiens
gaagaguggguuucacaagu

SEQ ID NO: 50353 - RNA, 21 nt, Homo sapiens
gaagaguggguuucacaagug

SEQ ID NO: 50354 - RNA, 17 nt, Homo sapiens
gaagauucuauguuaau

SEQ ID NO: 50355 - RNA, 14 nt, Homo sapiens
gaagcaacccaaau

SEQ ID NO: 50356 - RNA, 19 nt, Homo sapiens
gaagcaacccaaauguuca

SEQ ID NO: 50357 - RNA, 16 nt, Homo sapiens
gaagcaccaaucauga

SEQ ID NO: 50358 - RNA, 22 nt, Homo sapiens
gaagcauuuuauaaaucgcuuu

SEQ ID NO: 50359 - RNA, 15 nt, Homo sapiens
gaagcuuccauucca

SEQ ID NO: 50360 - RNA, 22 nt, Homo sapiens
gaagcuuccauuccaagccuga

SEQ ID NO: 50361 - RNA, 16 nt, Homo sapiens
gaaggcaaaugacuuu

SEQ ID NO: 50362 - RNA, 21 nt, Homo sapiens
gaaggcuguggauuuaaugug

SEQ ID NO: 50363 - RNA, 12 nt, Homo sapiens
gaaggggcggcg

SEQ ID NO: 50364 - RNA, 13 nt, Homo sapiens
gaaggggcggcgg

SEQ ID NO: 50365 - RNA, 14 nt, Homo sapiens
gaaggggcggcggc

SEQ ID NO: 50366 - RNA, 16 nt, Homo sapiens
gaaggggcggcggccc

SEQ ID NO: 50367 - RNA, 19 nt, Homo sapiens
gaaguacucauacauguua

SEQ ID NO: 50368 - RNA, 21 nt, Homo sapiens
gaaguauccuucagccugaaa

SEQ ID NO: 50369 - RNA, 20 nt, Homo sapiens
gaagucaaggcuuagacccu

SEQ ID NO: 50370 - RNA, 23 nt, Homo sapiens
gaagucaaggcuuagacccucau

SEQ ID NO: 50371 - RNA, 12 nt, Homo sapiens
gaagucuuccau

SEQ ID NO: 50372 - RNA, 16 nt, Homo sapiens
gaagucuuccauagag

SEQ ID NO: 50373 - RNA, 13 nt, Homo sapiens
gaagugaaacugc

SEQ ID NO: 50374 - RNA, 18 nt, Homo sapiens
gaaguuaagcaacaucua

SEQ ID NO: 50375 - RNA, 20 nt, Homo sapiens
gaaguugcagugagcugaua

SEQ ID NO: 50376 - RNA, 15 nt, Homo sapiens
gaauacauaaaguau

SEQ ID NO: 50377 - RNA, 23 nt, Homo sapiens
gaauacuaauaaaauacauacua

SEQ ID NO: 50378 - RNA, 23 nt, Homo sapiens
gaauaguguuggaaaaugugcaa

SEQ ID NO: 50379 - RNA, 14 nt, Homo sapiens
gaauauauaaccag

SEQ ID NO: 50380 - RNA, 16 nt, Homo sapiens
gaauauauuuccuuau

SEQ ID NO: 50381 - RNA, 19 nt, Homo sapiens
gaauaucuauuaauauaug

SEQ ID NO: 50382 - RNA, 17 nt, Homo sapiens
gaauauguaaauagaaa

SEQ ID NO: 50383 - RNA, 18 nt, Homo sapiens
gaauauuuauuaccucug

SEQ ID NO: 50384 - RNA, 21 nt, Homo sapiens
gaauauuuauuaccucugaua

SEQ ID NO: 50385 - RNA, 20 nt, Homo sapiens
gaaucacucauuuauuucca

SEQ ID NO: 50386 - RNA, 16 nt, Homo sapiens
gaaucacuugaacccg

SEQ ID NO: 50387 - RNA, 17 nt, Homo sapiens
gaaucagaucauuucaa

SEQ ID NO: 50388 - RNA, 15 nt, Homo sapiens
gaaucauaugggaua

SEQ ID NO: 50389 - RNA, 13 nt, Homo sapiens
gaaucuuuauagu

SEQ ID NO: 50390 - RNA, 14 nt, Homo sapiens
gaaucuuuauaguu

SEQ ID NO: 50391 - RNA, 11 nt, Homo sapiens
gaaugaaugaa

SEQ ID NO: 50392 - RNA, 23 nt, Homo sapiens
gaaugauuaugaauuacauuugu

SEQ ID NO: 50393 - RNA, 17 nt, Homo sapiens
gaaugucaguuguuauu

SEQ ID NO: 50394 - RNA, 13 nt, Homo sapiens
gaauguuuucaaa

SEQ ID NO: 50395 - RNA, 20 nt, Homo sapiens
gaauguuuucaaauguucuc

SEQ ID NO: 50396 - RNA, 15 nt, Homo sapiens
gaauuaguuuuauau

SEQ ID NO: 50397 - RNA, 22 nt, Homo sapiens
gaauugaauucccugccuggau

SEQ ID NO: 50398 - RNA, 12 nt, Homo sapiens
gaauuggagcuc

SEQ ID NO: 50399 - RNA, 14 nt, Homo sapiens
gaauuggagcucgu

SEQ ID NO: 50400 - RNA, 17 nt, Homo sapiens
gaauuggagcucguggg

SEQ ID NO: 50401 - RNA, 19 nt, Homo sapiens
gaauuguaggugacuauua

SEQ ID NO: 50402 - RNA, 17 nt, Homo sapiens
gaauuuauucaauuccu

SEQ ID NO: 50403 - RNA, 20 nt, Homo sapiens
gaauuuuucucuaacucaga

SEQ ID NO: 50404 - RNA, 15 nt, Homo sapiens
gacaaagacaaauuc

SEQ ID NO: 50405 - RNA, 21 nt, Homo sapiens
gacaaaugacccccaucccau

SEQ ID NO: 50406 - RNA, 13 nt, Homo sapiens
gacaaauucuguu

SEQ ID NO: 50407 - RNA, 13 nt, Homo sapiens
gacaacugugacu

SEQ ID NO: 50408 - RNA, 16 nt, Homo sapiens
gacaacugugacugua

SEQ ID NO: 50409 - RNA, 13 nt, Homo sapiens
gacaagcucacag

SEQ ID NO: 50410 - RNA, 13 nt, Homo sapiens
gacacacaugaag

SEQ ID NO: 50411 - RNA, 13 nt, Homo sapiens
gacacacugaaga

SEQ ID NO: 50412 - RNA, 19 nt, Homo sapiens
gacacagcugcagaggcca

SEQ ID NO: 50413 - RNA, 21 nt, Homo sapiens
gacacaggcuccaaacuggag

SEQ ID NO: 50414 - RNA, 16 nt, Homo sapiens
gacacaugcaagguca

SEQ ID NO: 50415 - RNA, 16 nt, Homo sapiens
gacacaugggugcuau

SEQ ID NO: 50416 - RNA, 11 nt, Homo sapiens
gacaccaccac

SEQ ID NO: 50417 - RNA, 12 nt, Homo sapiens
gacaccaccacc

SEQ ID NO: 50418 - RNA, 13 nt, Homo sapiens
gacaccaccaccc

SEQ ID NO: 50419 - RNA, 17 nt, Homo sapiens
gacaccaccacccuugc

SEQ ID NO: 50420 - RNA, 19 nt, Homo sapiens
gacagaaagcagaacagug

SEQ ID NO: 50421 - RNA, 21 nt, Homo sapiens
gacagaaagcagaacagugau

SEQ ID NO: 50422 - RNA, 20 nt, Homo sapiens
gacagcccuucuuuccacag

SEQ ID NO: 50423 - RNA, 19 nt, Homo sapiens
gacagucaccucauggaau

SEQ ID NO: 50424 - RNA, 14 nt, Homo sapiens
gacagugagacucu

SEQ ID NO: 50425 - RNA, 20 nt, Homo sapiens
gacaguuccugagaccagcc

SEQ ID NO: 50426 - RNA, 15 nt, Homo sapiens
gacauacuaaccagc

SEQ ID NO: 50427 - RNA, 20 nt, Homo sapiens
gacauacuaaccagcagaaa

SEQ ID NO: 50428 - RNA, 20 nt, Homo sapiens
gacauagaauuaacacauga

SEQ ID NO: 50429 - RNA, 15 nt, Homo sapiens
gacaucaacagauaa

SEQ ID NO: 50430 - RNA, 15 nt, Homo sapiens
gacaugggccccaga

SEQ ID NO: 50431 - RNA, 17 nt, Homo sapiens
gacaugggccccagaua

SEQ ID NO: 50432 - RNA, 18 nt, Homo sapiens
gacaugggccccagauac

SEQ ID NO: 50433 - RNA, 18 nt, Homo sapiens
gacauguuuacaaaccuc

SEQ ID NO: 50434 - RNA, 20 nt, Homo sapiens
gacauguuuacaaaccucaa

SEQ ID NO: 50435 - RNA, 22 nt, Homo sapiens
gacauguuuacaaaccucaagc

SEQ ID NO: 50436 - RNA, 23 nt, Homo sapiens
gacauguuuacaaaccucaagcc

SEQ ID NO: 50437 - RNA, 18 nt, Homo sapiens
gacauuuuaugucuuucu

SEQ ID NO: 50438 - RNA, 14 nt, Homo sapiens
gaccaaggcccccg

SEQ ID NO: 50439 - RNA, 15 nt, Homo sapiens
gaccaaggcccccgg

SEQ ID NO: 50440 - RNA, 20 nt, Homo sapiens
gaccaaggcccccgggccga

SEQ ID NO: 50441 - RNA, 22 nt, Homo sapiens
gaccaaggcccccgggccgacg

SEQ ID NO: 50442 - RNA, 23 nt, Homo sapiens
gaccaaggcccccgggccgacgg

SEQ ID NO: 50443 - RNA, 21 nt, Homo sapiens
gaccaauauuguacaguuuuu

SEQ ID NO: 50444 - RNA, 19 nt, Homo sapiens
gaccagccaaccugggggc

SEQ ID NO: 50445 - RNA, 18 nt, Homo sapiens
gaccaggcacccccagaa

SEQ ID NO: 50446 - RNA, 21 nt, Homo sapiens
gaccauaaccccggaagccaa

SEQ ID NO: 50447 - RNA, 12 nt, Homo sapiens
gaccaucccggc

SEQ ID NO: 50448 - RNA, 14 nt, Homo sapiens
gaccaucccggccg

SEQ ID NO: 50449 - RNA, 15 nt, Homo sapiens
gaccaucccggccgg

SEQ ID NO: 50450 - RNA, 16 nt, Homo sapiens
gaccaucccggccggc

SEQ ID NO: 50451 - RNA, 17 nt, Homo sapiens
gaccaucccggccggcg

SEQ ID NO: 50452 - RNA, 18 nt, Homo sapiens
gaccaucccggccggcgc

SEQ ID NO: 50453 - RNA, 20 nt, Homo sapiens
gaccaucccggccggcgcgc

SEQ ID NO: 50454 - RNA, 23 nt, Homo sapiens
gaccaucccggccggcgcgcuca

SEQ ID NO: 50455 - RNA, 15 nt, Homo sapiens
gacccaaaaggcaga

SEQ ID NO: 50456 - RNA, 15 nt, Homo sapiens
gacccccaucccaug

SEQ ID NO: 50457 - RNA, 16 nt, Homo sapiens
gacccccaucccaugg

SEQ ID NO: 50458 - RNA, 16 nt, Homo sapiens
gacccucaugcugcca

SEQ ID NO: 50459 - RNA, 17 nt, Homo sapiens
gacccucaugcugccaa

SEQ ID NO: 50460 - RNA, 20 nt, Homo sapiens
gacccucaugcugccaauau

SEQ ID NO: 50461 - RNA, 16 nt, Homo sapiens
gaccucugcagcaaua

SEQ ID NO: 50462 - RNA, 18 nt, Homo sapiens
gaccucugcagcaauaaa

SEQ ID NO: 50463 - RNA, 15 nt, Homo sapiens
gaccugacagcccaa

SEQ ID NO: 50464 - RNA, 10 nt, Homo sapiens
gaccugcugu

SEQ ID NO: 50465 - RNA, 21 nt, Homo sapiens
gaccugcuucuauuagcccuu

SEQ ID NO: 50466 - RNA, 17 nt, Homo sapiens
gaccugggccauaguca

SEQ ID NO: 50467 - RNA, 22 nt, Homo sapiens
gaccuggucgucgucuugacuu

SEQ ID NO: 50468 - RNA, 19 nt, Homo sapiens
gaccuguggccaaguucuu

SEQ ID NO: 50469 - RNA, 15 nt, Homo sapiens
gaccuucccagcuag

SEQ ID NO: 50470 - RNA, 23 nt, Homo sapiens
gaccuucccagcuagaauucacu

SEQ ID NO: 50471 - RNA, 12 nt, Homo sapiens
gacgaaccuuga

SEQ ID NO: 50472 - RNA, 14 nt, Homo sapiens
gacgaaccuugaaa

SEQ ID NO: 50473 - RNA, 16 nt, Homo sapiens
gacgcugcugccgugg

SEQ ID NO: 50474 - RNA, 18 nt, Homo sapiens
gacggagccgggaaagaa

SEQ ID NO: 50475 - RNA, 13 nt, Homo sapiens
gacggcuccggac

SEQ ID NO: 50476 - RNA, 17 nt, Homo sapiens
gacggcuccggacgcug

SEQ ID NO: 50477 - RNA, 19 nt, Homo sapiens
gacggcuccggacgcugcu

SEQ ID NO: 50478 - RNA, 13 nt, Homo sapiens
gacgggguuugcc

SEQ ID NO: 50479 - RNA, 17 nt, Homo sapiens
gacgggguuugccaugc

SEQ ID NO: 50480 - RNA, 20 nt, Homo sapiens
gacgggguuugccaugcugg

SEQ ID NO: 50481 - RNA, 23 nt, Homo sapiens
gacgggguuugccaugcuggcca

SEQ ID NO: 50482 - RNA, 21 nt, Homo sapiens
gacgguuuaaugggcacaggg

SEQ ID NO: 50483 - RNA, 15 nt, Homo sapiens
gacgugacuggccug

SEQ ID NO: 50484 - RNA, 16 nt, Homo sapiens
gacgugacuggccugc

SEQ ID NO: 50485 - RNA, 19 nt, Homo sapiens
gacgugacuggccugcugg

SEQ ID NO: 50486 - RNA, 20 nt, Homo sapiens
gacgugacuggccugcugga

SEQ ID NO: 50487 - RNA, 17 nt, Homo sapiens
gacgugauuuugcugua

SEQ ID NO: 50488 - RNA, 20 nt, Homo sapiens
gacgugauuuugcuguagaa

SEQ ID NO: 50489 - RNA, 13 nt, Homo sapiens
gacuaaaaaacaa

SEQ ID NO: 50490 - RNA, 19 nt, Homo sapiens
gacuaugaggaauauuugc

SEQ ID NO: 50491 - RNA, 23 nt, Homo sapiens
gacuccaaagaaauguaagggaa

SEQ ID NO: 50492 - RNA, 16 nt, Homo sapiens
gacugucucacuuaau

SEQ ID NO: 50493 - RNA, 15 nt, Homo sapiens
gacuuacuguacaug

SEQ ID NO: 50494 - RNA, 15 nt, Homo sapiens
gacuucauuaauaau

SEQ ID NO: 50495 - RNA, 20 nt, Homo sapiens
gacuucugucuucacaacag

SEQ ID NO: 50496 - RNA, 12 nt, Homo sapiens
gacuugaaccca

SEQ ID NO: 50497 - RNA, 19 nt, Homo sapiens
gacuuggccccugccaccu

SEQ ID NO: 50498 - RNA, 14 nt, Homo sapiens
gagaaaagacauaa

SEQ ID NO: 50499 - RNA, 17 nt, Homo sapiens
gagaaaauaaaagcacu

SEQ ID NO: 50500 - RNA, 19 nt, Homo sapiens
gagaaaauaaaagcacuua

SEQ ID NO: 50501 - RNA, 22 nt, Homo sapiens
gagaaaccuuauuguaccucuc

SEQ ID NO: 50502 - RNA, 15 nt, Homo sapiens
gagaaagacuauuca

SEQ ID NO: 50503 - RNA, 12 nt, Homo sapiens
gagaagaaugac

SEQ ID NO: 50504 - RNA, 14 nt, Homo sapiens
gagaaguuaagcaa

SEQ ID NO: 50505 - RNA, 16 nt, Homo sapiens
gagaauaaaaaaugua

SEQ ID NO: 50506 - RNA, 22 nt, Homo sapiens
gagaaucagaucauuucaaaac

SEQ ID NO: 50507 - RNA, 18 nt, Homo sapiens
gagacacaugggugcuau

SEQ ID NO: 50508 - RNA, 10 nt, Homo sapiens
gagacaccac

SEQ ID NO: 50509 - RNA, 11 nt, Homo sapiens
gagacaccacc

SEQ ID NO: 50510 - RNA, 12 nt, Homo sapiens
gagacaccacca

SEQ ID NO: 50511 - RNA, 13 nt, Homo sapiens
gagacaccaccac

SEQ ID NO: 50512 - RNA, 14 nt, Homo sapiens
gagacaccaccacc

SEQ ID NO: 50513 - RNA, 21 nt, Homo sapiens
gagacaccaccacccuugcca

SEQ ID NO: 50514 - RNA, 22 nt, Homo sapiens
gagacagaaagcagaacaguga

SEQ ID NO: 50515 - RNA, 13 nt, Homo sapiens
gagacagcagguc

SEQ ID NO: 50516 - RNA, 14 nt, Homo sapiens
gagacagcucugca

SEQ ID NO: 50517 - RNA, 19 nt, Homo sapiens
gagacagggaaagggucuc

SEQ ID NO: 50518 - RNA, 16 nt, Homo sapiens
gagaccaaggcccccg

SEQ ID NO: 50519 - RNA, 22 nt, Homo sapiens
gagaccaaggcccccgggccga

SEQ ID NO: 50520 - RNA, 12 nt, Homo sapiens
gagaccagccaa

SEQ ID NO: 50521 - RNA, 22 nt, Homo sapiens
gagaccagccaaccugggggcu

SEQ ID NO: 50522 - RNA, 18 nt, Homo sapiens
gagacgggguuugccaug

SEQ ID NO: 50523 - RNA, 21 nt, Homo sapiens
gagacgggguuugccaugcug

SEQ ID NO: 50524 - RNA, 23 nt, Homo sapiens
gagacgggguuugccaugcuggc

SEQ ID NO: 50525 - RNA, 16 nt, Homo sapiens
gagacucugucucagu

SEQ ID NO: 50526 - RNA, 15 nt, Homo sapiens
gagagagcuuggaau

SEQ ID NO: 50527 - RNA, 23 nt, Homo sapiens
gagagucuauuuacggaacucaa

SEQ ID NO: 50528 - RNA, 17 nt, Homo sapiens
gagauggguuugacaag

SEQ ID NO: 50529 - RNA, 16 nt, Homo sapiens
gagauuucaugccugg

SEQ ID NO: 50530 - RNA, 11 nt, Homo sapiens
gagcaaaaguu

SEQ ID NO: 50531 - RNA, 22 nt, Homo sapiens
gagcaagacucugucucaaaaa

SEQ ID NO: 50532 - RNA, 20 nt, Homo sapiens
gagcaccugcaggcgugacc

SEQ ID NO: 50533 - RNA, 14 nt, Homo sapiens
gagcagauguaaua

SEQ ID NO: 50534 - RNA, 14 nt, Homo sapiens
gagcaggcuacugu

SEQ ID NO: 50535 - RNA, 17 nt, Homo sapiens
gagcaggcuacugucag

SEQ ID NO: 50536 - RNA, 20 nt, Homo sapiens
gagcaggcuacugucagcuc

SEQ ID NO: 50537 - RNA, 12 nt, Homo sapiens
gagcaguagcag

SEQ ID NO: 50538 - RNA, 14 nt, Homo sapiens
gagcaguagcagca

SEQ ID NO: 50539 - RNA, 23 nt, Homo sapiens
gagcaguagcagcagcaucucug

SEQ ID NO: 50540 - RNA, 19 nt, Homo sapiens
gagcauuuauaaauggaca

SEQ ID NO: 50541 - RNA, 18 nt, Homo sapiens
gagccaccaaacccggcc

SEQ ID NO: 50542 - RNA, 22 nt, Homo sapiens
gagccaccaaacccggccugau

SEQ ID NO: 50543 - RNA, 20 nt, Homo sapiens
gagccaggaaucacuggcug

SEQ ID NO: 50544 - RNA, 19 nt, Homo sapiens
gagccccuugggcagguca

SEQ ID NO: 50545 - RNA, 20 nt, Homo sapiens
gagccccuugggcaggucac

SEQ ID NO: 50546 - RNA, 13 nt, Homo sapiens
gagccggagccuc

SEQ ID NO: 50547 - RNA, 16 nt, Homo sapiens
gagccggagccuccag

SEQ ID NO: 50548 - RNA, 17 nt, Homo sapiens
gagccggagccuccagc

SEQ ID NO: 50549 - RNA, 18 nt, Homo sapiens
gagccggagccuccagcu

SEQ ID NO: 50550 - RNA, 20 nt, Homo sapiens
gagccggagccuccagcugc

SEQ ID NO: 50551 - RNA, 17 nt, Homo sapiens
gagccgggaaagaagag

SEQ ID NO: 50552 - RNA, 18 nt, Homo sapiens
gagccgggaaagaagagc

SEQ ID NO: 50553 - RNA, 19 nt, Homo sapiens
gagccuccagcugccccgg

SEQ ID NO: 50554 - RNA, 20 nt, Homo sapiens
gagccuccagcugccccggg

SEQ ID NO: 50555 - RNA, 14 nt, Homo sapiens
gagccuuuguugcu

SEQ ID NO: 50556 - RNA, 12 nt, Homo sapiens
gagcgacaguga

SEQ ID NO: 50557 - RNA, 13 nt, Homo sapiens
gagcgacagugag

SEQ ID NO: 50558 - RNA, 13 nt, Homo sapiens
gagcgagccccag

SEQ ID NO: 50559 - RNA, 14 nt, Homo sapiens
gagcgagccccagg

SEQ ID NO: 50560 - RNA, 15 nt, Homo sapiens
gagcgagccccaggc

SEQ ID NO: 50561 - RNA, 20 nt, Homo sapiens
gagcgagccccaggcggguc

SEQ ID NO: 50562 - RNA, 15 nt, Homo sapiens
gagcgcgcgcgcccu

SEQ ID NO: 50563 - RNA, 16 nt, Homo sapiens
gagcgcgcgcgcccuc

SEQ ID NO: 50564 - RNA, 18 nt, Homo sapiens
gagcgcgcgcgcccucug

SEQ ID NO: 50565 - RNA, 14 nt, Homo sapiens
gagcuacaggcccc

SEQ ID NO: 50566 - RNA, 19 nt, Homo sapiens
gagcuaggggggucagcca

SEQ ID NO: 50567 - RNA, 21 nt, Homo sapiens
gagcuaggggggucagccagc

SEQ ID NO: 50568 - RNA, 11 nt, Homo sapiens
gagcucgugga

SEQ ID NO: 50569 - RNA, 11 nt, Homo sapiens
gagcucguggg

SEQ ID NO: 50570 - RNA, 19 nt, Homo sapiens
gagcugccucucucaucca

SEQ ID NO: 50571 - RNA, 18 nt, Homo sapiens
gagcuugaaauagugucu

SEQ ID NO: 50572 - RNA, 13 nt, Homo sapiens
gaggaaagagaga

SEQ ID NO: 50573 - RNA, 14 nt, Homo sapiens
gaggaaagagagac

SEQ ID NO: 50574 - RNA, 15 nt, Homo sapiens
gaggaaagagagaca

SEQ ID NO: 50575 - RNA, 19 nt, Homo sapiens
gaggaauccaagaaaaugg

SEQ ID NO: 50576 - RNA, 18 nt, Homo sapiens
gaggacuugggcgggaca

SEQ ID NO: 50577 - RNA, 15 nt, Homo sapiens
gaggagaaacuggaa

SEQ ID NO: 50578 - RNA, 14 nt, Homo sapiens
gaggagccugcaac

SEQ ID NO: 50579 - RNA, 16 nt, Homo sapiens
gaggagccugcaacau

SEQ ID NO: 50580 - RNA, 23 nt, Homo sapiens
gaggauguguggcauuuucacuu

SEQ ID NO: 50581 - RNA, 20 nt, Homo sapiens
gaggcaagagaauugcuuga

SEQ ID NO: 50582 - RNA, 21 nt, Homo sapiens
gaggcauuugcagcugugcca

SEQ ID NO: 50583 - RNA, 13 nt, Homo sapiens
gaggccuccucuc

SEQ ID NO: 50584 - RNA, 15 nt, Homo sapiens
gaggcggguggauca

SEQ ID NO: 50585 - RNA, 16 nt, Homo sapiens
gaggcugaggcaagag

SEQ ID NO: 50586 - RNA, 17 nt, Homo sapiens
gaggcugaggcgggugg

SEQ ID NO: 50587 - RNA, 18 nt, Homo sapiens
gaggcugaggcgggugga

SEQ ID NO: 50588 - RNA, 16 nt, Homo sapiens
gagggcgcggggcggg

SEQ ID NO: 50589 - RNA, 22 nt, Homo sapiens
gagggcgcggggcggggagcga

SEQ ID NO: 50590 - RNA, 14 nt, Homo sapiens
gagggcuaauaucu

SEQ ID NO: 50591 - RNA, 10 nt, Homo sapiens
gagggcuuga

SEQ ID NO: 50592 - RNA, 11 nt, Homo sapiens
gaggggcgcuc

SEQ ID NO: 50593 - RNA, 12 nt, Homo sapiens
gaggggcgcucg

SEQ ID NO: 50594 - RNA, 13 nt, Homo sapiens
gaggggcgcucgc

SEQ ID NO: 50595 - RNA, 17 nt, Homo sapiens
gagggggcgcgugcagg

SEQ ID NO: 50596 - RNA, 15 nt, Homo sapiens
gagguuaagcacuuu

SEQ ID NO: 50597 - RNA, 11 nt, Homo sapiens
gaguacuuccc

SEQ ID NO: 50598 - RNA, 16 nt, Homo sapiens
gaguacuucccgcugu

SEQ ID NO: 50599 - RNA, 22 nt, Homo sapiens
gaguacuucccgcuguuccucg

SEQ ID NO: 50600 - RNA, 20 nt, Homo sapiens
gagugacuuaguguacauga

SEQ ID NO: 50601 - RNA, 15 nt, Homo sapiens
gagugcaguggcgca

SEQ ID NO: 50602 - RNA, 18 nt, Homo sapiens
gagugcaguggcgcaauc

SEQ ID NO: 50603 - RNA, 21 nt, Homo sapiens
gaguggcauguaugacgugac

SEQ ID NO: 50604 - RNA, 14 nt, Homo sapiens
gaguggcgcgcgcc

SEQ ID NO: 50605 - RNA, 18 nt, Homo sapiens
gaguuaggcuauucacaa

SEQ ID NO: 50606 - RNA, 17 nt, Homo sapiens
gaguuccuaaccagccu

SEQ ID NO: 50607 - RNA, 18 nt, Homo sapiens
gaguucugucuggacuuu

SEQ ID NO: 50608 - RNA, 13 nt, Homo sapiens
gauaaacucagaa

SEQ ID NO: 50609 - RNA, 13 nt, Homo sapiens
gauaaagcacugu

SEQ ID NO: 50610 - RNA, 19 nt, Homo sapiens
gauaagcuauguuguugca

SEQ ID NO: 50611 - RNA, 20 nt, Homo sapiens
gauaauaaaauucauuccau

SEQ ID NO: 50612 - RNA, 18 nt, Homo sapiens
gauaaucucuccauuccc

SEQ ID NO: 50613 - RNA, 20 nt, Homo sapiens
gauacaaugaacacuuauaa

SEQ ID NO: 50614 - RNA, 11 nt, Homo sapiens
gauacagaaaa

SEQ ID NO: 50615 - RNA, 15 nt, Homo sapiens
gauaccaugaugcug

SEQ ID NO: 50616 - RNA, 12 nt, Homo sapiens
gauacuauuuaa

SEQ ID NO: 50617 - RNA, 19 nt, Homo sapiens
gauacuauuuaauuauuuc

SEQ ID NO: 50618 - RNA, 22 nt, Homo sapiens
gauacuguaucaugacaaagac

SEQ ID NO: 50619 - RNA, 14 nt, Homo sapiens
gauagagugggaca

SEQ ID NO: 50620 - RNA, 12 nt, Homo sapiens
gauagcaaguga

SEQ ID NO: 50621 - RNA, 12 nt, Homo sapiens
gauaggccaugg

SEQ ID NO: 50622 - RNA, 21 nt, Homo sapiens
gauagguuaccaguaacggaa

SEQ ID NO: 50623 - RNA, 21 nt, Homo sapiens
gauaucaugccccuguacucc

SEQ ID NO: 50624 - RNA, 14 nt, Homo sapiens
gauaucccaggaaa

SEQ ID NO: 50625 - RNA, 16 nt, Homo sapiens
gauaugccuuuuccca

SEQ ID NO: 50626 - RNA, 21 nt, Homo sapiens
gauaugccuuuucccaacucc

SEQ ID NO: 50627 - RNA, 20 nt, Homo sapiens
gauauguaacaacaauuauu

SEQ ID NO: 50628 - RNA, 15 nt, Homo sapiens
gauauuaacugagaa

SEQ ID NO: 50629 - RNA, 15 nt, Homo sapiens
gauauucucuaguca

SEQ ID NO: 50630 - RNA, 16 nt, Homo sapiens
gaucaaugugacggca

SEQ ID NO: 50631 - RNA, 21 nt, Homo sapiens
gaucaaugugacggcagggaa

SEQ ID NO: 50632 - RNA, 17 nt, Homo sapiens
gaucaguaugaaaaugu

SEQ ID NO: 50633 - RNA, 18 nt, Homo sapiens
gaucauuucaaaacucau

SEQ ID NO: 50634 - RNA, 13 nt, Homo sapiens
gauccgcccaucu

SEQ ID NO: 50635 - RNA, 19 nt, Homo sapiens
gauccgcccaucuccgucu

SEQ ID NO: 50636 - RNA, 17 nt, Homo sapiens
gauccugcaauuccacu

SEQ ID NO: 50637 - RNA, 16 nt, Homo sapiens
gaucucacaagcacuu

SEQ ID NO: 50638 - RNA, 17 nt, Homo sapiens
gaucucacaagcacuuu

SEQ ID NO: 50639 - RNA, 19 nt, Homo sapiens
gaucugcaacuacuaucca

SEQ ID NO: 50640 - RNA, 16 nt, Homo sapiens
gaucugcuuggucuug

SEQ ID NO: 50641 - RNA, 23 nt, Homo sapiens
gaugaaaacauagcaucucagga

SEQ ID NO: 50642 - RNA, 15 nt, Homo sapiens
gaugaucauguauuu

SEQ ID NO: 50643 - RNA, 17 nt, Homo sapiens
gaugcaguucugaagaa

SEQ ID NO: 50644 - RNA, 19 nt, Homo sapiens
gaugcaguuguugcccaca

SEQ ID NO: 50645 - RNA, 17 nt, Homo sapiens
gaugcuuguacauaaug

SEQ ID NO: 50646 - RNA, 18 nt, Homo sapiens
gauggaaguugcagugag

SEQ ID NO: 50647 - RNA, 18 nt, Homo sapiens
gauguagaggagaaacug

SEQ ID NO: 50648 - RNA, 15 nt, Homo sapiens
gauguauagguugau

SEQ ID NO: 50649 - RNA, 14 nt, Homo sapiens
gaugugaacacauc

SEQ ID NO: 50650 - RNA, 19 nt, Homo sapiens
gauguggagggggcgcgug

SEQ ID NO: 50651 - RNA, 21 nt, Homo sapiens
gauguuuagaaacacaacuau

SEQ ID NO: 50652 - RNA, 22 nt, Homo sapiens
gauguuuagaaacacaacuaua

SEQ ID NO: 50653 - RNA, 22 nt, Homo sapiens
gauguuuucacaaagaacagga

SEQ ID NO: 50654 - RNA, 23 nt, Homo sapiens
gauguuuucacaaagaacaggaa

SEQ ID NO: 50655 - RNA, 17 nt, Homo sapiens
gauguuuucauagagaa

SEQ ID NO: 50656 - RNA, 20 nt, Homo sapiens
gauuaacucuaccugcacac

SEQ ID NO: 50657 - RNA, 23 nt, Homo sapiens
gauuacaaggcuuuaucucaggg

SEQ ID NO: 50658 - RNA, 14 nt, Homo sapiens
gauuacccucuggg

SEQ ID NO: 50659 - RNA, 15 nt, Homo sapiens
gauuacccucugggu

SEQ ID NO: 50660 - RNA, 19 nt, Homo sapiens
gauucaagugauccgccca

SEQ ID NO: 50661 - RNA, 21 nt, Homo sapiens
gauucccagccagcacagccu

SEQ ID NO: 50662 - RNA, 22 nt, Homo sapiens
gauucccugagcaggauuuuaa

SEQ ID NO: 50663 - RNA, 13 nt, Homo sapiens
gauuccucacuuu

SEQ ID NO: 50664 - RNA, 14 nt, Homo sapiens
gauuccucacuuug

SEQ ID NO: 50665 - RNA, 18 nt, Homo sapiens
gauuguaaaaugguguga

SEQ ID NO: 50666 - RNA, 12 nt, Homo sapiens
gauugugggaua

SEQ ID NO: 50667 - RNA, 19 nt, Homo sapiens
gauugugggauacuauuua

SEQ ID NO: 50668 - RNA, 19 nt, Homo sapiens
gauuuuauaugcuauuuau

SEQ ID NO: 50669 - RNA, 15 nt, Homo sapiens
gauuuuaugcuuuaa

SEQ ID NO: 50670 - RNA, 21 nt, Homo sapiens
gcaaacugccaucauuuacuu

SEQ ID NO: 50671 - RNA, 17 nt, Homo sapiens
gcaaagaugaucaguau

SEQ ID NO: 50672 - RNA, 19 nt, Homo sapiens
gcaaaugagccggagcccc

SEQ ID NO: 50673 - RNA, 14 nt, Homo sapiens
gcaaaugcuguauu

SEQ ID NO: 50674 - RNA, 23 nt, Homo sapiens
gcaaaugcuguauucuucuuugg

SEQ ID NO: 50675 - RNA, 16 nt, Homo sapiens
gcaaauggccaaugag

SEQ ID NO: 50676 - RNA, 21 nt, Homo sapiens
gcaaauugucacaggacagcc

SEQ ID NO: 50677 - RNA, 19 nt, Homo sapiens
gcaacccaaauguucauca

SEQ ID NO: 50678 - RNA, 13 nt, Homo sapiens
gcaaccuccaccu

SEQ ID NO: 50679 - RNA, 18 nt, Homo sapiens
gcaaccuccaccuucugg

SEQ ID NO: 50680 - RNA, 22 nt, Homo sapiens
gcaaccuccaccuucuggguuc

SEQ ID NO: 50681 - RNA, 16 nt, Homo sapiens
gcaaccuuuggaugca

SEQ ID NO: 50682 - RNA, 12 nt, Homo sapiens
gcaacucugaag

SEQ ID NO: 50683 - RNA, 16 nt, Homo sapiens
gcaauaaaauguauuu

SEQ ID NO: 50684 - RNA, 23 nt, Homo sapiens
gcaaucuuaacucauugcaaccu

SEQ ID NO: 50685 - RNA, 20 nt, Homo sapiens
gcaaucuucucagaaggcaa

SEQ ID NO: 50686 - RNA, 21 nt, Homo sapiens
gcaaucuucucagaaggcaaa

SEQ ID NO: 50687 - RNA, 15 nt, Homo sapiens
gcaaugugacuuaau

SEQ ID NO: 50688 - RNA, 15 nt, Homo sapiens
gcacacagugcuuuc

SEQ ID NO: 50689 - RNA, 16 nt, Homo sapiens
gcacacagugcuuucc

SEQ ID NO: 50690 - RNA, 22 nt, Homo sapiens
gcacacucucccauuauauuua

SEQ ID NO: 50691 - RNA, 22 nt, Homo sapiens
gcacagccucuuagaugcaguu

SEQ ID NO: 50692 - RNA, 19 nt, Homo sapiens
gcacagugaucaaguuauu

SEQ ID NO: 50693 - RNA, 15 nt, Homo sapiens
gcacauauccuuagc

SEQ ID NO: 50694 - RNA, 14 nt, Homo sapiens
gcaccaacuuugaa

SEQ ID NO: 50695 - RNA, 15 nt, Homo sapiens
gcaccaaucaugaau

SEQ ID NO: 50696 - RNA, 22 nt, Homo sapiens
gcaccgcuguacgcgagcgcgc

SEQ ID NO: 50697 - RNA, 23 nt, Homo sapiens
gcaccgcuguacgcgagcgcgcg

SEQ ID NO: 50698 - RNA, 15 nt, Homo sapiens
gcaccuacaguguac

SEQ ID NO: 50699 - RNA, 12 nt, Homo sapiens
gcaccugcaggc

SEQ ID NO: 50700 - RNA, 14 nt, Homo sapiens
gcaccugcaggcgu

SEQ ID NO: 50701 - RNA, 15 nt, Homo sapiens
gcaccugcaggcgug

SEQ ID NO: 50702 - RNA, 16 nt, Homo sapiens
gcaccugcaggcguga

SEQ ID NO: 50703 - RNA, 16 nt, Homo sapiens
gcaccuguaaucccag

SEQ ID NO: 50704 - RNA, 22 nt, Homo sapiens
gcaccuuuagaauauuaaaaau

SEQ ID NO: 50705 - RNA, 15 nt, Homo sapiens
gcacgauuucuguuu

SEQ ID NO: 50706 - RNA, 19 nt, Homo sapiens
gcacgcauggaaaaguuuc

SEQ ID NO: 50707 - RNA, 20 nt, Homo sapiens
gcacgcauggaaaaguuucc

SEQ ID NO: 50708 - RNA, 22 nt, Homo sapiens
gcacuaaucaauacuuugaaca

SEQ ID NO: 50709 - RNA, 17 nt, Homo sapiens
gcacuccagccugagcg

SEQ ID NO: 50710 - RNA, 13 nt, Homo sapiens
gcacucuauguuc

SEQ ID NO: 50711 - RNA, 17 nt, Homo sapiens
gcacuuuaacacagugu

SEQ ID NO: 50712 - RNA, 19 nt, Homo sapiens
gcacuuuaacacagugucu

SEQ ID NO: 50713 - RNA, 22 nt, Homo sapiens
gcacuuuaacacagugucuggc

SEQ ID NO: 50714 - RNA, 21 nt, Homo sapiens
gcacuuucccucuuggugccu

SEQ ID NO: 50715 - RNA, 19 nt, Homo sapiens
gcagagacgggguuugcca

SEQ ID NO: 50716 - RNA, 21 nt, Homo sapiens
gcagagagguuucgauauuua

SEQ ID NO: 50717 - RNA, 21 nt, Homo sapiens
gcagagguugcagugagccga

SEQ ID NO: 50718 - RNA, 15 nt, Homo sapiens
gcagauaaacaguag

SEQ ID NO: 50719 - RNA, 14 nt, Homo sapiens
gcagauuuaagaua

SEQ ID NO: 50720 - RNA, 15 nt, Homo sapiens
gcagcaauaaagcag

SEQ ID NO: 50721 - RNA, 18 nt, Homo sapiens
gcagcaggauagaguggg

SEQ ID NO: 50722 - RNA, 18 nt, Homo sapiens
gcagcauaaauguugaca

SEQ ID NO: 50723 - RNA, 22 nt, Homo sapiens
gcagccaaccuaagcaagaucc

SEQ ID NO: 50724 - RNA, 15 nt, Homo sapiens
gcagcgaguacuucc

SEQ ID NO: 50725 - RNA, 17 nt, Homo sapiens
gcagcgaguacuucccg

SEQ ID NO: 50726 - RNA, 18 nt, Homo sapiens
gcagcgaguacuucccgc

SEQ ID NO: 50727 - RNA, 20 nt, Homo sapiens
gcagcgaguacuucccgcug

SEQ ID NO: 50728 - RNA, 13 nt, Homo sapiens
gcagcucaggcug

SEQ ID NO: 50729 - RNA, 15 nt, Homo sapiens
gcagcucaggcuggc

SEQ ID NO: 50730 - RNA, 16 nt, Homo sapiens
gcagcucaggcuggca

SEQ ID NO: 50731 - RNA, 17 nt, Homo sapiens
gcagcucaggcuggcac

SEQ ID NO: 50732 - RNA, 23 nt, Homo sapiens
gcagcucuaaaugucaaucagcc

SEQ ID NO: 50733 - RNA, 18 nt, Homo sapiens
gcagcuuauucacaagac

SEQ ID NO: 50734 - RNA, 17 nt, Homo sapiens
gcagcuugaaacugaga

SEQ ID NO: 50735 - RNA, 16 nt, Homo sapiens
gcaggaccaucccggc

SEQ ID NO: 50736 - RNA, 18 nt, Homo sapiens
gcaggaccaucccggccg

SEQ ID NO: 50737 - RNA, 21 nt, Homo sapiens
gcaggaccaucccggccggcg

SEQ ID NO: 50738 - RNA, 22 nt, Homo sapiens
gcaggaccaucccggccggcgc

SEQ ID NO: 50739 - RNA, 23 nt, Homo sapiens
gcaggaccaucccggccggcgcg

SEQ ID NO: 50740 - RNA, 14 nt, Homo sapiens
gcaggaggcaucca

SEQ ID NO: 50741 - RNA, 15 nt, Homo sapiens
gcaggcgugaccuga

SEQ ID NO: 50742 - RNA, 19 nt, Homo sapiens
gcaggcgugaccugacagc

SEQ ID NO: 50743 - RNA, 20 nt, Homo sapiens
gcaggcgugaccugacagcc

SEQ ID NO: 50744 - RNA, 15 nt, Homo sapiens
gcaggcuacugucag

SEQ ID NO: 50745 - RNA, 12 nt, Homo sapiens
gcagggacagga

SEQ ID NO: 50746 - RNA, 14 nt, Homo sapiens
gcagggacuugaac

SEQ ID NO: 50747 - RNA, 15 nt, Homo sapiens
gcagggacuugaacc

SEQ ID NO: 50748 - RNA, 16 nt, Homo sapiens
gcagggacuugaaccc

SEQ ID NO: 50749 - RNA, 17 nt, Homo sapiens
gcagggacuugaaccca

SEQ ID NO: 50750 - RNA, 20 nt, Homo sapiens
gcaggucacacaaccugucc

SEQ ID NO: 50751 - RNA, 13 nt, Homo sapiens
gcaguagcagcag

SEQ ID NO: 50752 - RNA, 19 nt, Homo sapiens
gcagucagaagaccugguc

SEQ ID NO: 50753 - RNA, 12 nt, Homo sapiens
gcagugagccga

SEQ ID NO: 50754 - RNA, 12 nt, Homo sapiens
gcagugagcuga

SEQ ID NO: 50755 - RNA, 21 nt, Homo sapiens
gcagugagcugauaucaugcc

SEQ ID NO: 50756 - RNA, 13 nt, Homo sapiens
gcagugaugucac

SEQ ID NO: 50757 - RNA, 13 nt, Homo sapiens
gcagugcuuggcc

SEQ ID NO: 50758 - RNA, 15 nt, Homo sapiens
gcagugcuuggccca

SEQ ID NO: 50759 - RNA, 17 nt, Homo sapiens
gcagugcuuggcccagg

SEQ ID NO: 50760 - RNA, 18 nt, Homo sapiens
gcagugcuuggcccagga

SEQ ID NO: 50761 - RNA, 21 nt, Homo sapiens
gcaguguuucccucuguguua

SEQ ID NO: 50762 - RNA, 13 nt, Homo sapiens
gcaguucugaaga

SEQ ID NO: 50763 - RNA, 14 nt, Homo sapiens
gcaguucugaagaa

SEQ ID NO: 50764 - RNA, 16 nt, Homo sapiens
gcaguucugaagaaga

SEQ ID NO: 50765 - RNA, 17 nt, Homo sapiens
gcaguucugaagaagau

SEQ ID NO: 50766 - RNA, 19 nt, Homo sapiens
gcaguugaaaagacuccaa

SEQ ID NO: 50767 - RNA, 13 nt, Homo sapiens
gcaguuuuccauu

SEQ ID NO: 50768 - RNA, 13 nt, Homo sapiens
gcauaaagucagu

SEQ ID NO: 50769 - RNA, 19 nt, Homo sapiens
gcauacugccuuguuuaau

SEQ ID NO: 50770 - RNA, 13 nt, Homo sapiens
gcauauguuucgc

SEQ ID NO: 50771 - RNA, 15 nt, Homo sapiens
gcaucacaguuuugg

SEQ ID NO: 50772 - RNA, 11 nt, Homo sapiens
gcauccuaguc

SEQ ID NO: 50773 - RNA, 12 nt, Homo sapiens
gcauccuagucu

SEQ ID NO: 50774 - RNA, 19 nt, Homo sapiens
gcauccuagucucuaucau

SEQ ID NO: 50775 - RNA, 16 nt, Homo sapiens
gcaucgcuuaggagaa

SEQ ID NO: 50776 - RNA, 18 nt, Homo sapiens
gcaugaaguaauaugcac

SEQ ID NO: 50777 - RNA, 19 nt, Homo sapiens
gcaugaaguaauaugcaca

SEQ ID NO: 50778 - RNA, 21 nt, Homo sapiens
gcaugaauuuuuuucaucuuc

SEQ ID NO: 50779 - RNA, 22 nt, Homo sapiens
gcaugggaagugacgguuuaau

SEQ ID NO: 50780 - RNA, 19 nt, Homo sapiens
gcauggguuuuauuauaua

SEQ ID NO: 50781 - RNA, 21 nt, Homo sapiens
gcaugguggcgcgcaccugua

SEQ ID NO: 50782 - RNA, 15 nt, Homo sapiens
gcauguaugacguga

SEQ ID NO: 50783 - RNA, 15 nt, Homo sapiens
gcauguuugugauug

SEQ ID NO: 50784 - RNA, 20 nt, Homo sapiens
gcauuaucuagauacuguau

SEQ ID NO: 50785 - RNA, 12 nt, Homo sapiens
gcauucaaaugu

SEQ ID NO: 50786 - RNA, 13 nt, Homo sapiens
gcauuccaacuau

SEQ ID NO: 50787 - RNA, 15 nt, Homo sapiens
gcauuccaacuaucu

SEQ ID NO: 50788 - RNA, 17 nt, Homo sapiens
gcauuguaaaugugcuu

SEQ ID NO: 50789 - RNA, 15 nt, Homo sapiens
gcauuguaacuuaug

SEQ ID NO: 50790 - RNA, 15 nt, Homo sapiens
gcauuuauaaaugga

SEQ ID NO: 50791 - RNA, 13 nt, Homo sapiens
gcauuuguuugaa

SEQ ID NO: 50792 - RNA, 15 nt, Homo sapiens
gcauuuucacuuuug

SEQ ID NO: 50793 - RNA, 16 nt, Homo sapiens
gcauuuucacuuuugg

SEQ ID NO: 50794 - RNA, 9 nt, Homo sapiens
gccaaaaac

SEQ ID NO: 50795 - RNA, 16 nt, Homo sapiens
gccaacuaggcagcca

SEQ ID NO: 50796 - RNA, 17 nt, Homo sapiens
gccaaggcuggagugca

SEQ ID NO: 50797 - RNA, 20 nt, Homo sapiens
gccaaggcuggagugcagug

SEQ ID NO: 50798 - RNA, 21 nt, Homo sapiens
gccaaggcuggagugcagugg

SEQ ID NO: 50799 - RNA, 22 nt, Homo sapiens
gccaaggcuggagugcaguggc

SEQ ID NO: 50800 - RNA, 15 nt, Homo sapiens
gccaccaaacccggc

SEQ ID NO: 50801 - RNA, 13 nt, Homo sapiens
gccaccuccugcc

SEQ ID NO: 50802 - RNA, 17 nt, Homo sapiens
gccacgcucugggucgc

SEQ ID NO: 50803 - RNA, 18 nt, Homo sapiens
gccacgcucugggucgcc

SEQ ID NO: 50804 - RNA, 21 nt, Homo sapiens
gccacgcucugggucgccggc

SEQ ID NO: 50805 - RNA, 22 nt, Homo sapiens
gccacgcucugggucgccggca

SEQ ID NO: 50806 - RNA, 23 nt, Homo sapiens
gccacgcucugggucgccggcau

SEQ ID NO: 50807 - RNA, 15 nt, Homo sapiens
gccacuucacuuuuu

SEQ ID NO: 50808 - RNA, 14 nt, Homo sapiens
gccagaagucaagg

SEQ ID NO: 50809 - RNA, 15 nt, Homo sapiens
gccagaagucaaggc

SEQ ID NO: 50810 - RNA, 17 nt, Homo sapiens
gccagacaucaacagau

SEQ ID NO: 50811 - RNA, 18 nt, Homo sapiens
gccagauuuuccugaaaa

SEQ ID NO: 50812 - RNA, 12 nt, Homo sapiens
gccagcaaauuc

SEQ ID NO: 50813 - RNA, 22 nt, Homo sapiens
gccaggaaucacuggcuguuaa

SEQ ID NO: 50814 - RNA, 14 nt, Homo sapiens
gccaggcuggucuc

SEQ ID NO: 50815 - RNA, 22 nt, Homo sapiens
gccaguaaaugggggugcauuu

SEQ ID NO: 50816 - RNA, 15 nt, Homo sapiens
gccagugagaucaau

SEQ ID NO: 50817 - RNA, 15 nt, Homo sapiens
gccaguuauggcuau

SEQ ID NO: 50818 - RNA, 19 nt, Homo sapiens
gccauaauuacuaugucau

SEQ ID NO: 50819 - RNA, 14 nt, Homo sapiens
gccaugaaucaccu

SEQ ID NO: 50820 - RNA, 19 nt, Homo sapiens
gccaugagaguucugucac

SEQ ID NO: 50821 - RNA, 16 nt, Homo sapiens
gccaugcuggccaggc

SEQ ID NO: 50822 - RNA, 15 nt, Homo sapiens
gccauggagguuaag

SEQ ID NO: 50823 - RNA, 20 nt, Homo sapiens
gccaugugauuacccucugg

SEQ ID NO: 50824 - RNA, 22 nt, Homo sapiens
gccaugugauuacccucugggu

SEQ ID NO: 50825 - RNA, 22 nt, Homo sapiens
gcccaacuguuauagguuguug

SEQ ID NO: 50826 - RNA, 14 nt, Homo sapiens
gcccaagggugggu

SEQ ID NO: 50827 - RNA, 22 nt, Homo sapiens
gcccacaccagggccuggcugg

SEQ ID NO: 50828 - RNA, 22 nt, Homo sapiens
gcccacagcuguaugauuccca

SEQ ID NO: 50829 - RNA, 19 nt, Homo sapiens
gcccacggcuggagcugcc

SEQ ID NO: 50830 - RNA, 15 nt, Homo sapiens
gcccacuuccucccg

SEQ ID NO: 50831 - RNA, 17 nt, Homo sapiens
gcccacuuccucccggc

SEQ ID NO: 50832 - RNA, 19 nt, Homo sapiens
gcccacuuccucccggccg

SEQ ID NO: 50833 - RNA, 20 nt, Homo sapiens
gcccacuuccucccggccgc

SEQ ID NO: 50834 - RNA, 21 nt, Homo sapiens
gcccacuuccucccggccgcg

SEQ ID NO: 50835 - RNA, 23 nt, Homo sapiens
gcccacuuccucccggccgcgcu

SEQ ID NO: 50836 - RNA, 11 nt, Homo sapiens
gcccagcuaau

SEQ ID NO: 50837 - RNA, 19 nt, Homo sapiens
gcccaggaguuuggccaga

SEQ ID NO: 50838 - RNA, 12 nt, Homo sapiens
gcccauccugcc

SEQ ID NO: 50839 - RNA, 21 nt, Homo sapiens
gcccauccugccccugagccc

SEQ ID NO: 50840 - RNA, 18 nt, Homo sapiens
gcccaucuccgucuccca

SEQ ID NO: 50841 - RNA, 20 nt, Homo sapiens
gcccaucuccgucucccaaa

SEQ ID NO: 50842 - RNA, 23 nt, Homo sapiens
gcccaucuuucaagggaccucuc

SEQ ID NO: 50843 - RNA, 15 nt, Homo sapiens
gccccaggcgggucc

SEQ ID NO: 50844 - RNA, 16 nt, Homo sapiens
gccccaggcggguccg

SEQ ID NO: 50845 - RNA, 17 nt, Homo sapiens
gccccaggcggguccgg

SEQ ID NO: 50846 - RNA, 22 nt, Homo sapiens
gccccaggcggguccgggucgc

SEQ ID NO: 50847 - RNA, 14 nt, Homo sapiens
gcccccgggccgac

SEQ ID NO: 50848 - RNA, 15 nt, Homo sapiens
gcccccgggccgacg

SEQ ID NO: 50849 - RNA, 16 nt, Homo sapiens
gcccccgggccgacgg

SEQ ID NO: 50850 - RNA, 20 nt, Homo sapiens
gcccccgggccgacggagcc

SEQ ID NO: 50851 - RNA, 22 nt, Homo sapiens
gcccccgggccgacggagccgg

SEQ ID NO: 50852 - RNA, 19 nt, Homo sapiens
gccccgggaguggcgcgcg

SEQ ID NO: 50853 - RNA, 13 nt, Homo sapiens
gccccggggaggg

SEQ ID NO: 50854 - RNA, 18 nt, Homo sapiens
gccccggggaggggcgcu

SEQ ID NO: 50855 - RNA, 13 nt, Homo sapiens
gccccugcacucc

SEQ ID NO: 50856 - RNA, 18 nt, Homo sapiens
gccccugcacuccagccu

SEQ ID NO: 50857 - RNA, 19 nt, Homo sapiens
gccccuguacuccagccug

SEQ ID NO: 50858 - RNA, 20 nt, Homo sapiens
gccccuguacuccagccugg

SEQ ID NO: 50859 - RNA, 18 nt, Homo sapiens
gccccuugggcaggucac

SEQ ID NO: 50860 - RNA, 15 nt, Homo sapiens
gcccggaaacuccac

SEQ ID NO: 50861 - RNA, 13 nt, Homo sapiens
gcccuagcauuuc

SEQ ID NO: 50862 - RNA, 14 nt, Homo sapiens
gcccucuggcugcu

SEQ ID NO: 50863 - RNA, 15 nt, Homo sapiens
gcccucuggcugcug

SEQ ID NO: 50864 - RNA, 20 nt, Homo sapiens
gcccucuggcugcugguggc

SEQ ID NO: 50865 - RNA, 22 nt, Homo sapiens
gcccucuggcugcugguggcgc

SEQ ID NO: 50866 - RNA, 20 nt, Homo sapiens
gcccugaaagucccagauca

SEQ ID NO: 50867 - RNA, 12 nt, Homo sapiens
gcccugccaugc

SEQ ID NO: 50868 - RNA, 19 nt, Homo sapiens
gcccugcccuuacaggaac

SEQ ID NO: 50869 - RNA, 14 nt, Homo sapiens
gcccugcugcugcc

SEQ ID NO: 50870 - RNA, 16 nt, Homo sapiens
gcccugcugcugccug

SEQ ID NO: 50871 - RNA, 12 nt, Homo sapiens
gcccugugcggc

SEQ ID NO: 50872 - RNA, 15 nt, Homo sapiens
gcccugugcggccug

SEQ ID NO: 50873 - RNA, 15 nt, Homo sapiens
gcccuucaugcauuu

SEQ ID NO: 50874 - RNA, 18 nt, Homo sapiens
gcccuucauguacaucca

SEQ ID NO: 50875 - RNA, 13 nt, Homo sapiens
gccgacggagccg

SEQ ID NO: 50876 - RNA, 16 nt, Homo sapiens
gccgacggagccggga

SEQ ID NO: 50877 - RNA, 18 nt, Homo sapiens
gccgagauugugccccug

SEQ ID NO: 50878 - RNA, 19 nt, Homo sapiens
gccgagauugugccccugc

SEQ ID NO: 50879 - RNA, 13 nt, Homo sapiens
gccgcgcuccucg

SEQ ID NO: 50880 - RNA, 14 nt, Homo sapiens
gccgcgcuccucgg

SEQ ID NO: 50881 - RNA, 11 nt, Homo sapiens
gccgcgcugcg

SEQ ID NO: 50882 - RNA, 12 nt, Homo sapiens
gccgcgcugcgc

SEQ ID NO: 50883 - RNA, 17 nt, Homo sapiens
gccgcgcugcgcgccgc

SEQ ID NO: 50884 - RNA, 23 nt, Homo sapiens
gccgcgcugcgcgccgcgcuccu

SEQ ID NO: 50885 - RNA, 13 nt, Homo sapiens
gccggagccccuu

SEQ ID NO: 50886 - RNA, 15 nt, Homo sapiens
gccggagccccuugg

SEQ ID NO: 50887 - RNA, 23 nt, Homo sapiens
gccggagccccuugggcagguca

SEQ ID NO: 50888 - RNA, 11 nt, Homo sapiens
gccggagccuc

SEQ ID NO: 50889 - RNA, 12 nt, Homo sapiens
gccggagccucc

SEQ ID NO: 50890 - RNA, 16 nt, Homo sapiens
gccggagccuccagcu

SEQ ID NO: 50891 - RNA, 17 nt, Homo sapiens
gccggagccuccagcug

SEQ ID NO: 50892 - RNA, 19 nt, Homo sapiens
gccggagccuccagcugcc

SEQ ID NO: 50893 - RNA, 13 nt, Homo sapiens
gccggcgcgcuca

SEQ ID NO: 50894 - RNA, 15 nt, Homo sapiens
gccggcgcgcucauc

SEQ ID NO: 50895 - RNA, 16 nt, Homo sapiens
gccggcgcgcucaucc

SEQ ID NO: 50896 - RNA, 22 nt, Homo sapiens
gccggcgcgcucaucccacccg

SEQ ID NO: 50897 - RNA, 16 nt, Homo sapiens
gccgggaaagaagagc

SEQ ID NO: 50898 - RNA, 17 nt, Homo sapiens
gccgggaaagaagagcc

SEQ ID NO: 50899 - RNA, 22 nt, Homo sapiens
gccgggaaagaagagccggagc

SEQ ID NO: 50900 - RNA, 23 nt, Homo sapiens
gccgggaaagaagagccggagcc

SEQ ID NO: 50901 - RNA, 15 nt, Homo sapiens
gccgggcaugguggc

SEQ ID NO: 50902 - RNA, 14 nt, Homo sapiens
gccgggcgcggugg

SEQ ID NO: 50903 - RNA, 19 nt, Homo sapiens
gccgguccuugcugcaccu

SEQ ID NO: 50904 - RNA, 14 nt, Homo sapiens
gccguccccagagc

SEQ ID NO: 50905 - RNA, 14 nt, Homo sapiens
gccgugggccugag

SEQ ID NO: 50906 - RNA, 16 nt, Homo sapiens
gccuagcccacuggcu

SEQ ID NO: 50907 - RNA, 19 nt, Homo sapiens
gccuagcccacuggcuccc

SEQ ID NO: 50908 - RNA, 17 nt, Homo sapiens
gccucaaucaguauuca

SEQ ID NO: 50909 - RNA, 13 nt, Homo sapiens
gccucaccucuca

SEQ ID NO: 50910 - RNA, 14 nt, Homo sapiens
gccucagcucucag

SEQ ID NO: 50911 - RNA, 20 nt, Homo sapiens
gccucagggugcacacagga

SEQ ID NO: 50912 - RNA, 12 nt, Homo sapiens
gccucaguuucc

SEQ ID NO: 50913 - RNA, 11 nt, Homo sapiens
gccuccagcug

SEQ ID NO: 50914 - RNA, 13 nt, Homo sapiens
gccuccagcugcc

SEQ ID NO: 50915 - RNA, 19 nt, Homo sapiens
gccuccagcugccccgggg

SEQ ID NO: 50916 - RNA, 13 nt, Homo sapiens
gccuccccagcuc

SEQ ID NO: 50917 - RNA, 16 nt, Homo sapiens
gccuccgcuacuucca

SEQ ID NO: 50918 - RNA, 21 nt, Homo sapiens
gccuccgcuacuuccagggcu

SEQ ID NO: 50919 - RNA, 13 nt, Homo sapiens
gccucuauugcca

SEQ ID NO: 50920 - RNA, 15 nt, Homo sapiens
gccucuauugccaug

SEQ ID NO: 50921 - RNA, 16 nt, Homo sapiens
gccucuauugccauga

SEQ ID NO: 50922 - RNA, 15 nt, Homo sapiens
gccucuuagaugcag

SEQ ID NO: 50923 - RNA, 20 nt, Homo sapiens
gccugagaccaaggcccccg

SEQ ID NO: 50924 - RNA, 23 nt, Homo sapiens
gccugagaccaaggcccccgggc

SEQ ID NO: 50925 - RNA, 19 nt, Homo sapiens
gccugaguguugccuaauu

SEQ ID NO: 50926 - RNA, 15 nt, Homo sapiens
gccugcaacaugcca

SEQ ID NO: 50927 - RNA, 15 nt, Homo sapiens
gccugcucgcccacu

SEQ ID NO: 50928 - RNA, 19 nt, Homo sapiens
gccugcucgcccacuuccu

SEQ ID NO: 50929 - RNA, 22 nt, Homo sapiens
gccugcucgcccacuuccuccc

SEQ ID NO: 50930 - RNA, 23 nt, Homo sapiens
gccugcucgcccacuuccucccg

SEQ ID NO: 50931 - RNA, 11 nt, Homo sapiens
gccugcuggau

SEQ ID NO: 50932 - RNA, 12 nt, Homo sapiens
gccugcuggaug

SEQ ID NO: 50933 - RNA, 13 nt, Homo sapiens
gccugcuggaugu

SEQ ID NO: 50934 - RNA, 17 nt, Homo sapiens
gccugcuggauguggag

SEQ ID NO: 50935 - RNA, 23 nt, Homo sapiens
gccugcuggauguggagggggcg

SEQ ID NO: 50936 - RNA, 21 nt, Homo sapiens
gccuggaucucacaagcacuu

SEQ ID NO: 50937 - RNA, 22 nt, Homo sapiens
gccuggaucucacaagcacuuu

SEQ ID NO: 50938 - RNA, 13 nt, Homo sapiens
gccuggcugggag

SEQ ID NO: 50939 - RNA, 14 nt, Homo sapiens
gccugggugacaga

SEQ ID NO: 50940 - RNA, 21 nt, Homo sapiens
gccuggucuaccuguucgcgc

SEQ ID NO: 50941 - RNA, 22 nt, Homo sapiens
gccuggucuaccuguucgcgcg

SEQ ID NO: 50942 - RNA, 19 nt, Homo sapiens
gccuguaaucccagcacuu

SEQ ID NO: 50943 - RNA, 20 nt, Homo sapiens
gccuguugaagaugcuugua

SEQ ID NO: 50944 - RNA, 16 nt, Homo sapiens
gccuugcuccuggcug

SEQ ID NO: 50945 - RNA, 17 nt, Homo sapiens
gccuugcuccuggcugg

SEQ ID NO: 50946 - RNA, 15 nt, Homo sapiens
gccuugguauagcau

SEQ ID NO: 50947 - RNA, 17 nt, Homo sapiens
gccuugguauagcauau

SEQ ID NO: 50948 - RNA, 14 nt, Homo sapiens
gccuuguuuaaugu

SEQ ID NO: 50949 - RNA, 21 nt, Homo sapiens
gccuuuguugcuaucaaucca

SEQ ID NO: 50950 - RNA, 22 nt, Homo sapiens
gcgaaugguuccauucucucuc

SEQ ID NO: 50951 - RNA, 21 nt, Homo sapiens
gcgacaguuuuccuucucauc

SEQ ID NO: 50952 - RNA, 13 nt, Homo sapiens
gcgagccccaggc

SEQ ID NO: 50953 - RNA, 15 nt, Homo sapiens
gcgagccccaggcgg

SEQ ID NO: 50954 - RNA, 16 nt, Homo sapiens
gcgagccccaggcggg

SEQ ID NO: 50955 - RNA, 11 nt, Homo sapiens
gcgagcgcgcg

SEQ ID NO: 50956 - RNA, 16 nt, Homo sapiens
gcgagcgcgcgcgccc

SEQ ID NO: 50957 - RNA, 19 nt, Homo sapiens
gcgagcgcgcgcgcccucu

SEQ ID NO: 50958 - RNA, 12 nt, Homo sapiens
gcgaguacuucc

SEQ ID NO: 50959 - RNA, 16 nt, Homo sapiens
gcgaguacuucccgcu

SEQ ID NO: 50960 - RNA, 21 nt, Homo sapiens
gcgaguacuucccgcuguucc

SEQ ID NO: 50961 - RNA, 22 nt, Homo sapiens
gcgaguacuucccgcuguuccu

SEQ ID NO: 50962 - RNA, 23 nt, Homo sapiens
gcgaguacuucccgcuguuccuc

SEQ ID NO: 50963 - RNA, 16 nt, Homo sapiens
gcgcagccaugugauu

SEQ ID NO: 50964 - RNA, 13 nt, Homo sapiens
gcgcagcucaggc

SEQ ID NO: 50965 - RNA, 18 nt, Homo sapiens
gcgcagcucaggcuggca

SEQ ID NO: 50966 - RNA, 14 nt, Homo sapiens
gcgccaccacgccc

SEQ ID NO: 50967 - RNA, 14 nt, Homo sapiens
gcgcccucuggcug

SEQ ID NO: 50968 - RNA, 17 nt, Homo sapiens
gcgcccucuggcugcug

SEQ ID NO: 50969 - RNA, 23 nt, Homo sapiens
gcgcccucuggcugcugguggcg

SEQ ID NO: 50970 - RNA, 18 nt, Homo sapiens
gcgccgcgcuccucggac

SEQ ID NO: 50971 - RNA, 23 nt, Homo sapiens
gcgccgcgcuccucggacggcuc

SEQ ID NO: 50972 - RNA, 14 nt, Homo sapiens
gcgccuaauguguu

SEQ ID NO: 50973 - RNA, 17 nt, Homo sapiens
gcgccuccgcuacuucc

SEQ ID NO: 50974 - RNA, 22 nt, Homo sapiens
gcgcgcaccuguaaucccagcu

SEQ ID NO: 50975 - RNA, 23 nt, Homo sapiens
gcgcgcaccuguaaucccagcua

SEQ ID NO: 50976 - RNA, 13 nt, Homo sapiens
gcgcgccaccacg

SEQ ID NO: 50977 - RNA, 19 nt, Homo sapiens
gcgcgcccucuggcugcug

SEQ ID NO: 50978 - RNA, 20 nt, Homo sapiens
gcgcgcccucuggcugcugg

SEQ ID NO: 50979 - RNA, 12 nt, Homo sapiens
gcgcgccgcgcu

SEQ ID NO: 50980 - RNA, 15 nt, Homo sapiens
gcgcgccgcgcuccu

SEQ ID NO: 50981 - RNA, 16 nt, Homo sapiens
gcgcgccgcgcuccuc

SEQ ID NO: 50982 - RNA, 18 nt, Homo sapiens
gcgcgccgcgcuccucgg

SEQ ID NO: 50983 - RNA, 11 nt, Homo sapiens
gcgcgccuccg

SEQ ID NO: 50984 - RNA, 12 nt, Homo sapiens
gcgcgccuccgc

SEQ ID NO: 50985 - RNA, 17 nt, Homo sapiens
gcgcgccuccgcuacuu

SEQ ID NO: 50986 - RNA, 16 nt, Homo sapiens
gcgcgcgccaccacgc

SEQ ID NO: 50987 - RNA, 13 nt, Homo sapiens
gcgcgcgcgcccu

SEQ ID NO: 50988 - RNA, 14 nt, Homo sapiens
gcgcgcgcgcccuc

SEQ ID NO: 50989 - RNA, 15 nt, Homo sapiens
gcgcgcgcgcccucu

SEQ ID NO: 50990 - RNA, 21 nt, Homo sapiens
gcgcgcucaucccacccgccc

SEQ ID NO: 50991 - RNA, 22 nt, Homo sapiens
gcgcgcucaucccacccgccca

SEQ ID NO: 50992 - RNA, 12 nt, Homo sapiens
gcgcgcuccgcg

SEQ ID NO: 50993 - RNA, 16 nt, Homo sapiens
gcgcgcuccgcgcagc

SEQ ID NO: 50994 - RNA, 17 nt, Homo sapiens
gcgcgcuccgcgcagcu

SEQ ID NO: 50995 - RNA, 19 nt, Homo sapiens
gcgcgcuccgcgcagcuca

SEQ ID NO: 50996 - RNA, 14 nt, Homo sapiens
gcgcggggcgggga

SEQ ID NO: 50997 - RNA, 23 nt, Homo sapiens
gcgcggggcggggagcgagcccc

SEQ ID NO: 50998 - RNA, 13 nt, Homo sapiens
gcgcgugcaggca

SEQ ID NO: 50999 - RNA, 20 nt, Homo sapiens
gcgcuaccucuccagccuca

SEQ ID NO: 51000 - RNA, 22 nt, Homo sapiens
gcgcuaccucuccagccucagc

SEQ ID NO: 51001 - RNA, 14 nt, Homo sapiens
gcgcucaucccacc

SEQ ID NO: 51002 - RNA, 17 nt, Homo sapiens
gcgcucaucccacccgc

SEQ ID NO: 51003 - RNA, 18 nt, Homo sapiens
gcgcucaucccacccgcc

SEQ ID NO: 51004 - RNA, 19 nt, Homo sapiens
gcgcucaucccacccgccc

SEQ ID NO: 51005 - RNA, 21 nt, Homo sapiens
gcgcucaucccacccgcccac

SEQ ID NO: 51006 - RNA, 18 nt, Homo sapiens
gcgcuccgcgcagcucag

SEQ ID NO: 51007 - RNA, 16 nt, Homo sapiens
gcgcuccucggacggc

SEQ ID NO: 51008 - RNA, 17 nt, Homo sapiens
gcgcuccucggacggcu

SEQ ID NO: 51009 - RNA, 16 nt, Homo sapiens
gcgcucggccugcucg

SEQ ID NO: 51010 - RNA, 23 nt, Homo sapiens
gcgcucggccugcucgcccacuu

SEQ ID NO: 51011 - RNA, 11 nt, Homo sapiens
gcgcugcgcgc

SEQ ID NO: 51012 - RNA, 12 nt, Homo sapiens
gcgcugcgcgcc

SEQ ID NO: 51013 - RNA, 13 nt, Homo sapiens
gcgcugcgcgccg

SEQ ID NO: 51014 - RNA, 15 nt, Homo sapiens
gcgcugcgcgccgcg

SEQ ID NO: 51015 - RNA, 12 nt, Homo sapiens
gcgcuggcugcg

SEQ ID NO: 51016 - RNA, 16 nt, Homo sapiens
gcgcuggcugcgcucg

SEQ ID NO: 51017 - RNA, 17 nt, Homo sapiens
gcggaccuucccagcua

SEQ ID NO: 51018 - RNA, 13 nt, Homo sapiens
gcggcccugugcg

SEQ ID NO: 51019 - RNA, 15 nt, Homo sapiens
gcggcccugugcggc

SEQ ID NO: 51020 - RNA, 17 nt, Homo sapiens
gcggcccugugcggccu

SEQ ID NO: 51021 - RNA, 18 nt, Homo sapiens
gcggcccugugcggccug

SEQ ID NO: 51022 - RNA, 19 nt, Homo sapiens
gcggcccugugcggccugg

SEQ ID NO: 51023 - RNA, 22 nt, Homo sapiens
gcggccuggucuaccuguucgc

SEQ ID NO: 51024 - RNA, 11 nt, Homo sapiens
gcggcggcccu

SEQ ID NO: 51025 - RNA, 12 nt, Homo sapiens
gcggcggcccug

SEQ ID NO: 51026 - RNA, 13 nt, Homo sapiens
gcggcggcccugu

SEQ ID NO: 51027 - RNA, 14 nt, Homo sapiens
gcggcggcccugug

SEQ ID NO: 51028 - RNA, 22 nt, Homo sapiens
gcggcggcccugugcggccugg

SEQ ID NO: 51029 - RNA, 18 nt, Homo sapiens
gcggcgggagggcgcggg

SEQ ID NO: 51030 - RNA, 22 nt, Homo sapiens
gcggcuggaauugaauucccug

SEQ ID NO: 51031 - RNA, 16 nt, Homo sapiens
gcgggacacaggcucc

SEQ ID NO: 51032 - RNA, 14 nt, Homo sapiens
gcgggagggcgcgg

SEQ ID NO: 51033 - RNA, 15 nt, Homo sapiens
gcgggagggcgcggg

SEQ ID NO: 51034 - RNA, 17 nt, Homo sapiens
gcgggagggcgcggggc

SEQ ID NO: 51035 - RNA, 13 nt, Homo sapiens
gcggggagcgagc

SEQ ID NO: 51036 - RNA, 11 nt, Homo sapiens
gcggguccggg

SEQ ID NO: 51037 - RNA, 22 nt, Homo sapiens
gcggguccgggucgcaggacca

SEQ ID NO: 51038 - RNA, 14 nt, Homo sapiens
gcgugagccaccaa

SEQ ID NO: 51039 - RNA, 22 nt, Homo sapiens
gcgugagccaccaaacccggcc

SEQ ID NO: 51040 - RNA, 13 nt, Homo sapiens
gcgugcaggcagc

SEQ ID NO: 51041 - RNA, 19 nt, Homo sapiens
gcgugcaggcagcaggaua

SEQ ID NO: 51042 - RNA, 17 nt, Homo sapiens
gcuaagauauaauuuaa

SEQ ID NO: 51043 - RNA, 20 nt, Homo sapiens
gcuaaguugcaccaacuuug

SEQ ID NO: 51044 - RNA, 15 nt, Homo sapiens
gcuaauuuguguauu

SEQ ID NO: 51045 - RNA, 16 nt, Homo sapiens
gcuacaaaaacacagc

SEQ ID NO: 51046 - RNA, 14 nt, Homo sapiens
gcuaccucuccagc

SEQ ID NO: 51047 - RNA, 15 nt, Homo sapiens
gcuaccucuccagcc

SEQ ID NO: 51048 - RNA, 16 nt, Homo sapiens
gcuaccucuccagccu

SEQ ID NO: 51049 - RNA, 13 nt, Homo sapiens
gcuaccuuuguau

SEQ ID NO: 51050 - RNA, 14 nt, Homo sapiens
gcuacgcgcgcucc

SEQ ID NO: 51051 - RNA, 15 nt, Homo sapiens
gcuacgcgcgcuccg

SEQ ID NO: 51052 - RNA, 17 nt, Homo sapiens
gcuacgcgcgcuccgcg

SEQ ID NO: 51053 - RNA, 18 nt, Homo sapiens
gcuacgcgcgcuccgcgc

SEQ ID NO: 51054 - RNA, 19 nt, Homo sapiens
gcuacgcgcgcuccgcgca

SEQ ID NO: 51055 - RNA, 14 nt, Homo sapiens
gcuacucuguuccu

SEQ ID NO: 51056 - RNA, 20 nt, Homo sapiens
gcuacucuguuccuucacau

SEQ ID NO: 51057 - RNA, 21 nt, Homo sapiens
gcuacucuguuccuucacauc

SEQ ID NO: 51058 - RNA, 14 nt, Homo sapiens
gcuacuuccagggc

SEQ ID NO: 51059 - RNA, 20 nt, Homo sapiens
gcuacuuccagggcuacgcg

SEQ ID NO: 51060 - RNA, 21 nt, Homo sapiens
gcuacuuccagggcuacgcgc

SEQ ID NO: 51061 - RNA, 19 nt, Homo sapiens
gcuagaaaacaggcaaauu

SEQ ID NO: 51062 - RNA, 16 nt, Homo sapiens
gcuagaauucacucca

SEQ ID NO: 51063 - RNA, 13 nt, Homo sapiens
gcuagaauuugau

SEQ ID NO: 51064 - RNA, 14 nt, Homo sapiens
gcuagaauuugaua

SEQ ID NO: 51065 - RNA, 22 nt, Homo sapiens
gcuagaauuugauaugugaaca

SEQ ID NO: 51066 - RNA, 20 nt, Homo sapiens
gcuaggggggucagccagcc

SEQ ID NO: 51067 - RNA, 12 nt, Homo sapiens
gcuaucgccauc

SEQ ID NO: 51068 - RNA, 20 nt, Homo sapiens
gcuaucgccaucacagcuga

SEQ ID NO: 51069 - RNA, 23 nt, Homo sapiens
gcuaucgccaucacagcugaacu

SEQ ID NO: 51070 - RNA, 11 nt, Homo sapiens
gcuaugcauuu

SEQ ID NO: 51071 - RNA, 12 nt, Homo sapiens
gcuaugcauuug

SEQ ID NO: 51072 - RNA, 13 nt, Homo sapiens
gcuaugcauuuga

SEQ ID NO: 51073 - RNA, 15 nt, Homo sapiens
gcuaugcuauugaag

SEQ ID NO: 51074 - RNA, 13 nt, Homo sapiens
gcuauguuguugc

SEQ ID NO: 51075 - RNA, 16 nt, Homo sapiens
gcuauuuaaagacaaa

SEQ ID NO: 51076 - RNA, 23 nt, Homo sapiens
gcucacgccuguaaucccagcac

SEQ ID NO: 51077 - RNA, 12 nt, Homo sapiens
gcucaggcuggc

SEQ ID NO: 51078 - RNA, 13 nt, Homo sapiens
gcucaggcuggca

SEQ ID NO: 51079 - RNA, 15 nt, Homo sapiens
gcucaggcuggcacc

SEQ ID NO: 51080 - RNA, 20 nt, Homo sapiens
gcucaggcuggcaccgcugu

SEQ ID NO: 51081 - RNA, 23 nt, Homo sapiens
gcucaggcuggcaccgcuguacg

SEQ ID NO: 51082 - RNA, 15 nt, Homo sapiens
gcucaucccacccgc

SEQ ID NO: 51083 - RNA, 16 nt, Homo sapiens
gcucaucccacccgcc

SEQ ID NO: 51084 - RNA, 17 nt, Homo sapiens
gcucaucccacccgccc

SEQ ID NO: 51085 - RNA, 18 nt, Homo sapiens
gcucaucccacccgccca

SEQ ID NO: 51086 - RNA, 19 nt, Homo sapiens
gcucaucccacccgcccac

SEQ ID NO: 51087 - RNA, 14 nt, Homo sapiens
gcucauggaauugg

SEQ ID NO: 51088 - RNA, 15 nt, Homo sapiens
gcucauggaauugga

SEQ ID NO: 51089 - RNA, 19 nt, Homo sapiens
gcucauggaauuggagcuc

SEQ ID NO: 51090 - RNA, 21 nt, Homo sapiens
gcucauggaauuggagcucgu

SEQ ID NO: 51091 - RNA, 19 nt, Homo sapiens
gcucccuggaagagaucaa

SEQ ID NO: 51092 - RNA, 13 nt, Homo sapiens
gcuccgcgcagcu

SEQ ID NO: 51093 - RNA, 18 nt, Homo sapiens
gcuccgcgcagcucaggc

SEQ ID NO: 51094 - RNA, 20 nt, Homo sapiens
gcuccgcgcagcucaggcug

SEQ ID NO: 51095 - RNA, 16 nt, Homo sapiens
gcuccggacgcugcug

SEQ ID NO: 51096 - RNA, 17 nt, Homo sapiens
gcuccggacgcugcugc

SEQ ID NO: 51097 - RNA, 18 nt, Homo sapiens
gcuccggacgcugcugcc

SEQ ID NO: 51098 - RNA, 19 nt, Homo sapiens
gcuccggacgcugcugccg

SEQ ID NO: 51099 - RNA, 22 nt, Homo sapiens
gcuccggacgcugcugccgugg

SEQ ID NO: 51100 - RNA, 24 nt, Homo sapiens
gcuccggacgcugcugccgugggc

SEQ ID NO: 51101 - RNA, 16 nt, Homo sapiens
gcuccucggacggcuc

SEQ ID NO: 51102 - RNA, 17 nt, Homo sapiens
gcuccucggacggcucc

SEQ ID NO: 51103 - RNA, 18 nt, Homo sapiens
gcuccucggacggcuccg

SEQ ID NO: 51104 - RNA, 20 nt, Homo sapiens
gcuccucggacggcuccgga

SEQ ID NO: 51105 - RNA, 17 nt, Homo sapiens
gcuccugagacacaugg

SEQ ID NO: 51106 - RNA, 16 nt, Homo sapiens
gcucgcccacuuccuc

SEQ ID NO: 51107 - RNA, 18 nt, Homo sapiens
gcucgcccacuuccuccc

SEQ ID NO: 51108 - RNA, 19 nt, Homo sapiens
gcucgcccacuuccucccg

SEQ ID NO: 51109 - RNA, 14 nt, Homo sapiens
gcucgcuuccgcau

SEQ ID NO: 51110 - RNA, 16 nt, Homo sapiens
gcucgcuuccgcaucc

SEQ ID NO: 51111 - RNA, 11 nt, Homo sapiens
gcucggccugc

SEQ ID NO: 51112 - RNA, 12 nt, Homo sapiens
gcucggccugcu

SEQ ID NO: 51113 - RNA, 14 nt, Homo sapiens
gcucggccugcucg

SEQ ID NO: 51114 - RNA, 16 nt, Homo sapiens
gcucggccugcucgcc

SEQ ID NO: 51115 - RNA, 18 nt, Homo sapiens
gcucggccugcucgccca

SEQ ID NO: 51116 - RNA, 20 nt, Homo sapiens
gcucggccugcucgcccacu

SEQ ID NO: 51117 - RNA, 17 nt, Homo sapiens
gcucuccaaaccacuuu

SEQ ID NO: 51118 - RNA, 18 nt, Homo sapiens
gcucuccaaaccacuuuu

SEQ ID NO: 51119 - RNA, 19 nt, Homo sapiens
gcucuccaaaccacuuuuu

SEQ ID NO: 51120 - RNA, 22 nt, Homo sapiens
gcucucugaccuccuccuucau

SEQ ID NO: 51121 - RNA, 15 nt, Homo sapiens
gcucuggaaaccaca

SEQ ID NO: 51122 - RNA, 13 nt, Homo sapiens
gcucugggucgcc

SEQ ID NO: 51123 - RNA, 14 nt, Homo sapiens
gcucugggucgccg

SEQ ID NO: 51124 - RNA, 16 nt, Homo sapiens
gcucugggucgccggc

SEQ ID NO: 51125 - RNA, 18 nt, Homo sapiens
gcucugggucgccggcau

SEQ ID NO: 51126 - RNA, 23 nt, Homo sapiens
gcugaaccguuugugauugccau

SEQ ID NO: 51127 - RNA, 24 nt, Homo sapiens
gcugaaccguuugugauugccauu

SEQ ID NO: 51128 - RNA, 23 nt, Homo sapiens
gcugagcagauguaauagaaaua

SEQ ID NO: 51129 - RNA, 19 nt, Homo sapiens
gcugagcagucagaagacc

SEQ ID NO: 51130 - RNA, 12 nt, Homo sapiens
gcugaggcgggu

SEQ ID NO: 51131 - RNA, 15 nt, Homo sapiens
gcugaggcgggugga

SEQ ID NO: 51132 - RNA, 22 nt, Homo sapiens
gcugaguguuucacaccuuauc

SEQ ID NO: 51133 - RNA, 18 nt, Homo sapiens
gcugauaucaugccccug

SEQ ID NO: 51134 - RNA, 14 nt, Homo sapiens
gcugcaccugugcc

SEQ ID NO: 51135 - RNA, 12 nt, Homo sapiens
gcugcauuuaaa

SEQ ID NO: 51136 - RNA, 12 nt, Homo sapiens
gcugccccgggg

SEQ ID NO: 51137 - RNA, 13 nt, Homo sapiens
gcugccccgggga

SEQ ID NO: 51138 - RNA, 14 nt, Homo sapiens
gcugccccggggag

SEQ ID NO: 51139 - RNA, 19 nt, Homo sapiens
gcugccccggggaggggcg

SEQ ID NO: 51140 - RNA, 22 nt, Homo sapiens
gcugccccggggaggggcgcuc

SEQ ID NO: 51141 - RNA, 15 nt, Homo sapiens
gcugccgugggccug

SEQ ID NO: 51142 - RNA, 16 nt, Homo sapiens
gcugccgugggccuga

SEQ ID NO: 51143 - RNA, 18 nt, Homo sapiens
gcugccgugggccugaga

SEQ ID NO: 51144 - RNA, 22 nt, Homo sapiens
gcugccgugggccugagaccaa

SEQ ID NO: 51145 - RNA, 22 nt, Homo sapiens
gcugccucuaaaaggccugucc

SEQ ID NO: 51146 - RNA, 10 nt, Homo sapiens
gcugcgcgcc

SEQ ID NO: 51147 - RNA, 12 nt, Homo sapiens
gcugcgcgccgc

SEQ ID NO: 51148 - RNA, 14 nt, Homo sapiens
gcugcgcgccgcgc

SEQ ID NO: 51149 - RNA, 15 nt, Homo sapiens
gcugcgcgccgcgcu

SEQ ID NO: 51150 - RNA, 16 nt, Homo sapiens
gcugcgcgccgcgcuc

SEQ ID NO: 51151 - RNA, 20 nt, Homo sapiens
gcugcgcgccgcgcuccucg

SEQ ID NO: 51152 - RNA, 11 nt, Homo sapiens
gcugcgcucgg

SEQ ID NO: 51153 - RNA, 12 nt, Homo sapiens
gcugcgcucggc

SEQ ID NO: 51154 - RNA, 14 nt, Homo sapiens
gcugcgcucggccu

SEQ ID NO: 51155 - RNA, 15 nt, Homo sapiens
gcugcgcucggccug

SEQ ID NO: 51156 - RNA, 17 nt, Homo sapiens
gcugcgcucggccugcu

SEQ ID NO: 51157 - RNA, 19 nt, Homo sapiens
gcugcgcucggccugcucg

SEQ ID NO: 51158 - RNA, 20 nt, Homo sapiens
gcugcgcucggccugcucgc

SEQ ID NO: 51159 - RNA, 14 nt, Homo sapiens
gcugcucugugguc

SEQ ID NO: 51160 - RNA, 12 nt, Homo sapiens
gcugcugccugc

SEQ ID NO: 51161 - RNA, 13 nt, Homo sapiens
gcugcugguggcg

SEQ ID NO: 51162 - RNA, 14 nt, Homo sapiens
gcugcugguggcgc

SEQ ID NO: 51163 - RNA, 17 nt, Homo sapiens
gcugcugguggcgcugg

SEQ ID NO: 51164 - RNA, 18 nt, Homo sapiens
gcugcugguggcgcuggc

SEQ ID NO: 51165 - RNA, 20 nt, Homo sapiens
gcugcugguggcgcuggcug

SEQ ID NO: 51166 - RNA, 23 nt, Homo sapiens
gcugcugguggcgcuggcugcgc

SEQ ID NO: 51167 - RNA, 15 nt, Homo sapiens
gcuggagcucugccc

SEQ ID NO: 51168 - RNA, 18 nt, Homo sapiens
gcuggagcucugcccauc

SEQ ID NO: 51169 - RNA, 19 nt, Homo sapiens
gcuggagcugccucucuca

SEQ ID NO: 51170 - RNA, 19 nt, Homo sapiens
gcuggagugcaguggcgca

SEQ ID NO: 51171 - RNA, 19 nt, Homo sapiens
gcuggauguggagggggcg

SEQ ID NO: 51172 - RNA, 22 nt, Homo sapiens
gcuggcaccgcuguacgcgagc

SEQ ID NO: 51173 - RNA, 23 nt, Homo sapiens
gcuggcaccgcuguacgcgagcg

SEQ ID NO: 51174 - RNA, 24 nt, Homo sapiens
gcuggcaccgcuguacgcgagcgc

SEQ ID NO: 51175 - RNA, 14 nt, Homo sapiens
gcuggccaggcugg

SEQ ID NO: 51176 - RNA, 14 nt, Homo sapiens
gcuggcugcgcucg

SEQ ID NO: 51177 - RNA, 21 nt, Homo sapiens
gcuggcugcgcucggccugcu

SEQ ID NO: 51178 - RNA, 22 nt, Homo sapiens
gcuggcugcgcucggccugcuc

SEQ ID NO: 51179 - RNA, 20 nt, Homo sapiens
gcugggaauuacaggcguga

SEQ ID NO: 51180 - RNA, 23 nt, Homo sapiens
gcugggaauuacaggcgugagcc

SEQ ID NO: 51181 - RNA, 24 nt, Homo sapiens
gcugggaauuacaggcgugagcca

SEQ ID NO: 51182 - RNA, 14 nt, Homo sapiens
gcugggaguggcau

SEQ ID NO: 51183 - RNA, 23 nt, Homo sapiens
gcugggccuggauggcugccuca

SEQ ID NO: 51184 - RNA, 19 nt, Homo sapiens
gcuggucucgaacugcugg

SEQ ID NO: 51185 - RNA, 15 nt, Homo sapiens
gcugguggcgcuggc

SEQ ID NO: 51186 - RNA, 17 nt, Homo sapiens
gcugguggcgcuggcug

SEQ ID NO: 51187 - RNA, 19 nt, Homo sapiens
gcugguggcgcuggcugcg

SEQ ID NO: 51188 - RNA, 13 nt, Homo sapiens
gcuguacgcgagc

SEQ ID NO: 51189 - RNA, 14 nt, Homo sapiens
gcuguacgcgagcg

SEQ ID NO: 51190 - RNA, 18 nt, Homo sapiens
gcuguacgcgagcgcgcg

SEQ ID NO: 51191 - RNA, 22 nt, Homo sapiens
gcuguacgcgagcgcgcgcgcc

SEQ ID NO: 51192 - RNA, 14 nt, Homo sapiens
gcuguagaagaugg

SEQ ID NO: 51193 - RNA, 12 nt, Homo sapiens
gcuguauucuuc

SEQ ID NO: 51194 - RNA, 21 nt, Homo sapiens
gcuguauuuuaaaagaaugau

SEQ ID NO: 51195 - RNA, 19 nt, Homo sapiens
gcugucuacacuaagagag

SEQ ID NO: 51196 - RNA, 14 nt, Homo sapiens
gcuguggccagcuu

SEQ ID NO: 51197 - RNA, 18 nt, Homo sapiens
gcuguuaaucuuucaaag

SEQ ID NO: 51198 - RNA, 20 nt, Homo sapiens
gcuguuauuuuaucugcuau

SEQ ID NO: 51199 - RNA, 12 nt, Homo sapiens
gcuguuccucgc

SEQ ID NO: 51200 - RNA, 22 nt, Homo sapiens
gcuguuccucgccacgcucugg

SEQ ID NO: 51201 - RNA, 20 nt, Homo sapiens
gcuguuuccauagggugaca

SEQ ID NO: 51202 - RNA, 19 nt, Homo sapiens
gcuguuuuuauauauguga

SEQ ID NO: 51203 - RNA, 14 nt, Homo sapiens
gcuuagacccucau

SEQ ID NO: 51204 - RNA, 15 nt, Homo sapiens
gcuuagacccucaug

SEQ ID NO: 51205 - RNA, 21 nt, Homo sapiens
gcuuagacccucaugcugcca

SEQ ID NO: 51206 - RNA, 22 nt, Homo sapiens
gcuuagacccucaugcugccaa

SEQ ID NO: 51207 - RNA, 14 nt, Homo sapiens
gcuuccaaauauug

SEQ ID NO: 51208 - RNA, 12 nt, Homo sapiens
gcuuccuaacug

SEQ ID NO: 51209 - RNA, 14 nt, Homo sapiens
gcuuccuaacugcu

SEQ ID NO: 51210 - RNA, 17 nt, Homo sapiens
gcuucugggcagacucu

SEQ ID NO: 51211 - RNA, 18 nt, Homo sapiens
gcuugaaauagugucuga

SEQ ID NO: 51212 - RNA, 22 nt, Homo sapiens
gcuugaaauagugucugaugaa

SEQ ID NO: 51213 - RNA, 13 nt, Homo sapiens
gcuugaacccagg

SEQ ID NO: 51214 - RNA, 14 nt, Homo sapiens
gcuugaacccagga

SEQ ID NO: 51215 - RNA, 19 nt, Homo sapiens
gcuugaggacuugggcggg

SEQ ID NO: 51216 - RNA, 21 nt, Homo sapiens
gcuugcccuguuaaaagauga

SEQ ID NO: 51217 - RNA, 19 nt, Homo sapiens
gcuuggcccaggaguuugg

SEQ ID NO: 51218 - RNA, 20 nt, Homo sapiens
gcuuguauuuuacuuuucca

SEQ ID NO: 51219 - RNA, 14 nt, Homo sapiens
gcuuuaauaucauc

SEQ ID NO: 51220 - RNA, 22 nt, Homo sapiens
gcuuucauaacaucgaaaaguu

SEQ ID NO: 51221 - RNA, 15 nt, Homo sapiens
gcuuucccaacagcu

SEQ ID NO: 51222 - RNA, 19 nt, Homo sapiens
gcuuuccguggcacugcau

SEQ ID NO: 51223 - RNA, 21 nt, Homo sapiens
gcuuuccucaaaacuucagac

SEQ ID NO: 51224 - RNA, 23 nt, Homo sapiens
gcuuucuagcuguugagcuguuu

SEQ ID NO: 51225 - RNA, 12 nt, Homo sapiens
gcuuuugauaau

SEQ ID NO: 51226 - RNA, 15 nt, Homo sapiens
gcuuuugugcauuau

SEQ ID NO: 51227 - RNA, 22 nt, Homo sapiens
ggaaaaaacaccaggauuuaag

SEQ ID NO: 51228 - RNA, 19 nt, Homo sapiens
ggaaacuccacauccugug

SEQ ID NO: 51229 - RNA, 15 nt, Homo sapiens
ggaaagaagagccgg

SEQ ID NO: 51230 - RNA, 12 nt, Homo sapiens
ggaaaggcagcu

SEQ ID NO: 51231 - RNA, 14 nt, Homo sapiens
ggaaagggucuccc

SEQ ID NO: 51232 - RNA, 15 nt, Homo sapiens
ggaaagggucucccu

SEQ ID NO: 51233 - RNA, 14 nt, Homo sapiens
ggaaauacacuguu

SEQ ID NO: 51234 - RNA, 20 nt, Homo sapiens
ggaaauauuuuaauguuucu

SEQ ID NO: 51235 - RNA, 19 nt, Homo sapiens
ggaaauguaugugugucua

SEQ ID NO: 51236 - RNA, 14 nt, Homo sapiens
ggaacagaagagga

SEQ ID NO: 51237 - RNA, 16 nt, Homo sapiens
ggaacaugagccuuug

SEQ ID NO: 51238 - RNA, 23 nt, Homo sapiens
ggaacaugagccuuuguugcuau

SEQ ID NO: 51239 - RNA, 18 nt, Homo sapiens
ggaagccucuauugccau

SEQ ID NO: 51240 - RNA, 16 nt, Homo sapiens
ggaauauauaaccagu

SEQ ID NO: 51241 - RNA, 22 nt, Homo sapiens
ggaauauuugcaagacauagaa

SEQ ID NO: 51242 - RNA, 22 nt, Homo sapiens
ggaaucacuggcuguuaaucuu

SEQ ID NO: 51243 - RNA, 17 nt, Homo sapiens
ggaaugaaguacucaua

SEQ ID NO: 51244 - RNA, 21 nt, Homo sapiens
ggaauuacaggcgugagccac

SEQ ID NO: 51245 - RNA, 15 nt, Homo sapiens
ggaauugaggacacu

SEQ ID NO: 51246 - RNA, 16 nt, Homo sapiens
ggaauuggagcucgug

SEQ ID NO: 51247 - RNA, 17 nt, Homo sapiens
ggaauuggagcucgugg

SEQ ID NO: 51248 - RNA, 15 nt, Homo sapiens
ggaauuuucuuccaa

SEQ ID NO: 51249 - RNA, 16 nt, Homo sapiens
ggacaaaaacaaacaa

SEQ ID NO: 51250 - RNA, 16 nt, Homo sapiens
ggacacaggcuccaaa

SEQ ID NO: 51251 - RNA, 17 nt, Homo sapiens
ggacagucaccucaugg

SEQ ID NO: 51252 - RNA, 18 nt, Homo sapiens
ggacagucaccucaugga

SEQ ID NO: 51253 - RNA, 16 nt, Homo sapiens
ggacaguuccugagac

SEQ ID NO: 51254 - RNA, 24 nt, Homo sapiens
ggacaguuccugagaccagccaac

SEQ ID NO: 51255 - RNA, 10 nt, Homo sapiens
ggacaugggc

SEQ ID NO: 51256 - RNA, 15 nt, Homo sapiens
ggacauuugcucaug

SEQ ID NO: 51257 - RNA, 17 nt, Homo sapiens
ggacauuugcucaugga

SEQ ID NO: 51258 - RNA, 14 nt, Homo sapiens
ggaccaucccggcc

SEQ ID NO: 51259 - RNA, 15 nt, Homo sapiens
ggaccaucccggccg

SEQ ID NO: 51260 - RNA, 18 nt, Homo sapiens
ggaccaucccggccggcg

SEQ ID NO: 51261 - RNA, 19 nt, Homo sapiens
ggaccaucccggccggcgc

SEQ ID NO: 51262 - RNA, 15 nt, Homo sapiens
ggaccucuccaugau

SEQ ID NO: 51263 - RNA, 11 nt, Homo sapiens
ggaccugcugu

SEQ ID NO: 51264 - RNA, 14 nt, Homo sapiens
ggacgcugcugccg

SEQ ID NO: 51265 - RNA, 19 nt, Homo sapiens
ggacgcugcugccgugggc

SEQ ID NO: 51266 - RNA, 11 nt, Homo sapiens
ggacggcuccg

SEQ ID NO: 51267 - RNA, 14 nt, Homo sapiens
ggacggcuccggac

SEQ ID NO: 51268 - RNA, 20 nt, Homo sapiens
ggacggcuccggacgcugcu

SEQ ID NO: 51269 - RNA, 13 nt, Homo sapiens
ggacuuccauuug

SEQ ID NO: 51270 - RNA, 14 nt, Homo sapiens
ggacuugggcggga

SEQ ID NO: 51271 - RNA, 24 nt, Homo sapiens
ggacuugggcgggacacaggcucc

SEQ ID NO: 51272 - RNA, 13 nt, Homo sapiens
ggagaaacuggaa

SEQ ID NO: 51273 - RNA, 10 nt, Homo sapiens
ggagaagaac

SEQ ID NO: 51274 - RNA, 11 nt, Homo sapiens
ggagaagaacu

SEQ ID NO: 51275 - RNA, 15 nt, Homo sapiens
ggagaaucacuugaa

SEQ ID NO: 51276 - RNA, 16 nt, Homo sapiens
ggagaaucacuugaac

SEQ ID NO: 51277 - RNA, 14 nt, Homo sapiens
ggagacaccaccac

SEQ ID NO: 51278 - RNA, 15 nt, Homo sapiens
ggagacaccaccacc

SEQ ID NO: 51279 - RNA, 16 nt, Homo sapiens
ggagacaccaccaccc

SEQ ID NO: 51280 - RNA, 17 nt, Homo sapiens
ggagacaccaccacccu

SEQ ID NO: 51281 - RNA, 18 nt, Homo sapiens
ggagagaagauagcaggg

SEQ ID NO: 51282 - RNA, 17 nt, Homo sapiens
ggagccgggaaagaaga

SEQ ID NO: 51283 - RNA, 21 nt, Homo sapiens
ggagccgggaaagaagagccg

SEQ ID NO: 51284 - RNA, 13 nt, Homo sapiens
ggagccuccagcu

SEQ ID NO: 51285 - RNA, 16 nt, Homo sapiens
ggagccuccagcugcc

SEQ ID NO: 51286 - RNA, 18 nt, Homo sapiens
ggagccuccagcugcccc

SEQ ID NO: 51287 - RNA, 23 nt, Homo sapiens
ggagccugcaacaugccagccac

SEQ ID NO: 51288 - RNA, 19 nt, Homo sapiens
ggagcgagccccaggcggg

SEQ ID NO: 51289 - RNA, 16 nt, Homo sapiens
ggagcuagaauuugau

SEQ ID NO: 51290 - RNA, 12 nt, Homo sapiens
ggagcucgugga

SEQ ID NO: 51291 - RNA, 12 nt, Homo sapiens
ggagcucguggg

SEQ ID NO: 51292 - RNA, 21 nt, Homo sapiens
ggagcucugcccauccugccc

SEQ ID NO: 51293 - RNA, 10 nt, Homo sapiens
ggagcugccu

SEQ ID NO: 51294 - RNA, 12 nt, Homo sapiens
ggagcugccucu

SEQ ID NO: 51295 - RNA, 22 nt, Homo sapiens
ggagcugccucucucauccacu

SEQ ID NO: 51296 - RNA, 21 nt, Homo sapiens
ggagcuugaaauagugucuga

SEQ ID NO: 51297 - RNA, 20 nt, Homo sapiens
ggaggcagagguugcaguga

SEQ ID NO: 51298 - RNA, 15 nt, Homo sapiens
ggaggcugaggcaag

SEQ ID NO: 51299 - RNA, 13 nt, Homo sapiens
ggaggggcgcucg

SEQ ID NO: 51300 - RNA, 16 nt, Homo sapiens
ggaguaccauaauucu

SEQ ID NO: 51301 - RNA, 17 nt, Homo sapiens
ggaguaccauaauucug

SEQ ID NO: 51302 - RNA, 18 nt, Homo sapiens
ggaguaccauaauucugg

SEQ ID NO: 51303 - RNA, 18 nt, Homo sapiens
ggaguuaggcuauucaca

SEQ ID NO: 51304 - RNA, 20 nt, Homo sapiens
ggaguuaggcuauucacaac

SEQ ID NO: 51305 - RNA, 20 nt, Homo sapiens
ggaguuccuaaccagccugg

SEQ ID NO: 51306 - RNA, 15 nt, Homo sapiens
ggaguuuggccagaa

SEQ ID NO: 51307 - RNA, 21 nt, Homo sapiens
ggaguuuggccagaagucaag

SEQ ID NO: 51308 - RNA, 15 nt, Homo sapiens
ggauacuauuuaauu

SEQ ID NO: 51309 - RNA, 19 nt, Homo sapiens
ggauagcugacccagcccc

SEQ ID NO: 51310 - RNA, 12 nt, Homo sapiens
ggauaugagaug

SEQ ID NO: 51311 - RNA, 16 nt, Homo sapiens
ggauaugagauguagc

SEQ ID NO: 51312 - RNA, 15 nt, Homo sapiens
ggaucucacaagcac

SEQ ID NO: 51313 - RNA, 17 nt, Homo sapiens
ggaucucacaagcacuu

SEQ ID NO: 51314 - RNA, 12 nt, Homo sapiens
ggaugcccacgg

SEQ ID NO: 51315 - RNA, 15 nt, Homo sapiens
ggaugcuuguacaua

SEQ ID NO: 51316 - RNA, 16 nt, Homo sapiens
ggauuuaacagaaaug

SEQ ID NO: 51317 - RNA, 22 nt, Homo sapiens
ggauuuaacagaaauguacagc

SEQ ID NO: 51318 - RNA, 12 nt, Homo sapiens
ggauuugcaacc

SEQ ID NO: 51319 - RNA, 13 nt, Homo sapiens
ggauuugcaaccc

SEQ ID NO: 51320 - RNA, 16 nt, Homo sapiens
ggcaagggaccugcuu

SEQ ID NO: 51321 - RNA, 21 nt, Homo sapiens
ggcaauguucccccucuccuc

SEQ ID NO: 51322 - RNA, 15 nt, Homo sapiens
ggcaccgcuguacgc

SEQ ID NO: 51323 - RNA, 16 nt, Homo sapiens
ggcaccgcuguacgcg

SEQ ID NO: 51324 - RNA, 21 nt, Homo sapiens
ggcaccgcuguacgcgagcgc

SEQ ID NO: 51325 - RNA, 14 nt, Homo sapiens
ggcacuugggacaa

SEQ ID NO: 51326 - RNA, 21 nt, Homo sapiens
ggcagagguugcagugagccg

SEQ ID NO: 51327 - RNA, 19 nt, Homo sapiens
ggcagcaggauagaguggg

SEQ ID NO: 51328 - RNA, 18 nt, Homo sapiens
ggcagcuuuccucaaaac

SEQ ID NO: 51329 - RNA, 17 nt, Homo sapiens
ggcaggaccuguggcca

SEQ ID NO: 51330 - RNA, 15 nt, Homo sapiens
ggcaggcaucgccau

SEQ ID NO: 51331 - RNA, 16 nt, Homo sapiens
ggcaggcaucgccauu

SEQ ID NO: 51332 - RNA, 13 nt, Homo sapiens
ggcagggacagga

SEQ ID NO: 51333 - RNA, 20 nt, Homo sapiens
ggcaggucacacaaccuguc

SEQ ID NO: 51334 - RNA, 14 nt, Homo sapiens
ggcagugcuuggcc

SEQ ID NO: 51335 - RNA, 15 nt, Homo sapiens
ggcagugcuuggccc

SEQ ID NO: 51336 - RNA, 18 nt, Homo sapiens
ggcagugcuuggcccagg

SEQ ID NO: 51337 - RNA, 19 nt, Homo sapiens
ggcagugcuuggcccagga

SEQ ID NO: 51338 - RNA, 21 nt, Homo sapiens
ggcagugcuuggcccaggagu

SEQ ID NO: 51339 - RNA, 20 nt, Homo sapiens
ggcaguggugguuuucuguu

SEQ ID NO: 51340 - RNA, 21 nt, Homo sapiens
ggcauacugccuuguuuaaug

SEQ ID NO: 51341 - RNA, 19 nt, Homo sapiens
ggcauauuuaacaaaauuu

SEQ ID NO: 51342 - RNA, 20 nt, Homo sapiens
ggcauauuuaacaaaauuug

SEQ ID NO: 51343 - RNA, 10 nt, Homo sapiens
ggcaucaugc

SEQ ID NO: 51344 - RNA, 15 nt, Homo sapiens
ggccagaagucaagg

SEQ ID NO: 51345 - RNA, 16 nt, Homo sapiens
ggccagaagucaaggc

SEQ ID NO: 51346 - RNA, 20 nt, Homo sapiens
ggccagaagucaaggcuuag

SEQ ID NO: 51347 - RNA, 21 nt, Homo sapiens
ggccagugagaucaaugugac

SEQ ID NO: 51348 - RNA, 19 nt, Homo sapiens
ggcccaggaguuuggccag

SEQ ID NO: 51349 - RNA, 20 nt, Homo sapiens
ggcccaggaguuuggccaga

SEQ ID NO: 51350 - RNA, 22 nt, Homo sapiens
ggcccaggaguuuggccagaag

SEQ ID NO: 51351 - RNA, 13 nt, Homo sapiens
ggcccccgggccg

SEQ ID NO: 51352 - RNA, 14 nt, Homo sapiens
ggcccccgggccga

SEQ ID NO: 51353 - RNA, 15 nt, Homo sapiens
ggcccccgggccgac

SEQ ID NO: 51354 - RNA, 20 nt, Homo sapiens
ggcccccgggccgacggagc

SEQ ID NO: 51355 - RNA, 16 nt, Homo sapiens
ggcccugccaugcucu

SEQ ID NO: 51356 - RNA, 19 nt, Homo sapiens
ggcccugccaugcucucca

SEQ ID NO: 51357 - RNA, 14 nt, Homo sapiens
ggcccugugcggcc

SEQ ID NO: 51358 - RNA, 20 nt, Homo sapiens
ggcccugugcggccuggucu

SEQ ID NO: 51359 - RNA, 13 nt, Homo sapiens
ggccgacggagcc

SEQ ID NO: 51360 - RNA, 15 nt, Homo sapiens
ggccgacggagccgg

SEQ ID NO: 51361 - RNA, 18 nt, Homo sapiens
ggccgacggagccgggaa

SEQ ID NO: 51362 - RNA, 19 nt, Homo sapiens
ggccgacggagccgggaaa

SEQ ID NO: 51363 - RNA, 10 nt, Homo sapiens
ggccgcgcug

SEQ ID NO: 51364 - RNA, 11 nt, Homo sapiens
ggccgcgcugc

SEQ ID NO: 51365 - RNA, 12 nt, Homo sapiens
ggccgcgcugcg

SEQ ID NO: 51366 - RNA, 13 nt, Homo sapiens
ggccgcgcugcgc

SEQ ID NO: 51367 - RNA, 16 nt, Homo sapiens
ggccgcgcugcgcgcc

SEQ ID NO: 51368 - RNA, 18 nt, Homo sapiens
ggccgcgcugcgcgccgc

SEQ ID NO: 51369 - RNA, 19 nt, Homo sapiens
ggccgcgcugcgcgccgcg

SEQ ID NO: 51370 - RNA, 13 nt, Homo sapiens
ggccggcgcgcuc

SEQ ID NO: 51371 - RNA, 14 nt, Homo sapiens
ggccggcgcgcuca

SEQ ID NO: 51372 - RNA, 15 nt, Homo sapiens
ggccgggcgcggugg

SEQ ID NO: 51373 - RNA, 20 nt, Homo sapiens
ggccuccucucucaguuuuu

SEQ ID NO: 51374 - RNA, 17 nt, Homo sapiens
ggccugagaccaaggcc

SEQ ID NO: 51375 - RNA, 21 nt, Homo sapiens
ggccugagaccaaggcccccg

SEQ ID NO: 51376 - RNA, 18 nt, Homo sapiens
ggccuggucuaccuguuc

SEQ ID NO: 51377 - RNA, 20 nt, Homo sapiens
ggccuggucuaccuguucgc

SEQ ID NO: 51378 - RNA, 13 nt, Homo sapiens
ggcgacaguuuuc

SEQ ID NO: 51379 - RNA, 20 nt, Homo sapiens
ggcgcgcaccuguaauccca

SEQ ID NO: 51380 - RNA, 14 nt, Homo sapiens
ggcgcgcgccacca

SEQ ID NO: 51381 - RNA, 14 nt, Homo sapiens
ggcgcgcucauccc

SEQ ID NO: 51382 - RNA, 23 nt, Homo sapiens
ggcgcggcgggagggcgcggggc

SEQ ID NO: 51383 - RNA, 11 nt, Homo sapiens
ggcgcggggcg

SEQ ID NO: 51384 - RNA, 12 nt, Homo sapiens
ggcgcggggcgg

SEQ ID NO: 51385 - RNA, 13 nt, Homo sapiens
ggcgcggggcggg

SEQ ID NO: 51386 - RNA, 21 nt, Homo sapiens
ggcgcggggcggggagcgagc

SEQ ID NO: 51387 - RNA, 14 nt, Homo sapiens
ggcgcgguggcuca

SEQ ID NO: 51388 - RNA, 13 nt, Homo sapiens
ggcgcgugcaggc

SEQ ID NO: 51389 - RNA, 13 nt, Homo sapiens
ggcgcucgcuucc

SEQ ID NO: 51390 - RNA, 17 nt, Homo sapiens
ggcgcucgcuuccgcau

SEQ ID NO: 51391 - RNA, 18 nt, Homo sapiens
ggcgcucgcuuccgcauc

SEQ ID NO: 51392 - RNA, 19 nt, Homo sapiens
ggcgcucgcuuccgcaucc

SEQ ID NO: 51393 - RNA, 20 nt, Homo sapiens
ggcgcucgcuuccgcauccu

SEQ ID NO: 51394 - RNA, 12 nt, Homo sapiens
ggcgcuggcugc

SEQ ID NO: 51395 - RNA, 16 nt, Homo sapiens
ggcgcuggcugcgcuc

SEQ ID NO: 51396 - RNA, 17 nt, Homo sapiens
ggcgcuggcugcgcucg

SEQ ID NO: 51397 - RNA, 21 nt, Homo sapiens
ggcgcuggcugcgcucggccu

SEQ ID NO: 51398 - RNA, 21 nt, Homo sapiens
ggcggcccugugcggccuggu

SEQ ID NO: 51399 - RNA, 10 nt, Homo sapiens
ggcggcggcc

SEQ ID NO: 51400 - RNA, 11 nt, Homo sapiens
ggcggcggccc

SEQ ID NO: 51401 - RNA, 21 nt, Homo sapiens
ggcggcggcccugugcggccu

SEQ ID NO: 51402 - RNA, 20 nt, Homo sapiens
ggcggcuggaauugaauucc

SEQ ID NO: 51403 - RNA, 20 nt, Homo sapiens
ggcgggagggcgcggggcgg

SEQ ID NO: 51404 - RNA, 14 nt, Homo sapiens
ggcggggagcgagc

SEQ ID NO: 51405 - RNA, 15 nt, Homo sapiens
ggcggguccgggucg

SEQ ID NO: 51406 - RNA, 18 nt, Homo sapiens
ggcggguccgggucgcag

SEQ ID NO: 51407 - RNA, 19 nt, Homo sapiens
ggcggguccgggucgcagg

SEQ ID NO: 51408 - RNA, 20 nt, Homo sapiens
ggcggguccgggucgcagga

SEQ ID NO: 51409 - RNA, 21 nt, Homo sapiens
ggcggguccgggucgcaggac

SEQ ID NO: 51410 - RNA, 14 nt, Homo sapiens
ggcgugagccacca

SEQ ID NO: 51411 - RNA, 15 nt, Homo sapiens
ggcgugagccaccaa

SEQ ID NO: 51412 - RNA, 16 nt, Homo sapiens
ggcgugagccaccaaa

SEQ ID NO: 51413 - RNA, 17 nt, Homo sapiens
ggcgugagccaccaaac

SEQ ID NO: 51414 - RNA, 12 nt, Homo sapiens
ggcuacgcgcgc

SEQ ID NO: 51415 - RNA, 13 nt, Homo sapiens
ggcuacgcgcgcu

SEQ ID NO: 51416 - RNA, 14 nt, Homo sapiens
ggcuacgcgcgcuc

SEQ ID NO: 51417 - RNA, 16 nt, Homo sapiens
ggcuacgcgcgcuccg

SEQ ID NO: 51418 - RNA, 18 nt, Homo sapiens
ggcuacgcgcgcuccgcg

SEQ ID NO: 51419 - RNA, 22 nt, Homo sapiens
ggcuacgcgcgcuccgcgcagc

SEQ ID NO: 51420 - RNA, 12 nt, Homo sapiens
ggcuacugucag

SEQ ID NO: 51421 - RNA, 10 nt, Homo sapiens
ggcuagaacc

SEQ ID NO: 51422 - RNA, 11 nt, Homo sapiens
ggcuaugcauu

SEQ ID NO: 51423 - RNA, 22 nt, Homo sapiens
ggcuauuuaaagacaaagacaa

SEQ ID NO: 51424 - RNA, 21 nt, Homo sapiens
ggcucacgccuguaaucccag

SEQ ID NO: 51425 - RNA, 22 nt, Homo sapiens
ggcucacgccuguaaucccagc

SEQ ID NO: 51426 - RNA, 14 nt, Homo sapiens
ggcuccggacgcug

SEQ ID NO: 51427 - RNA, 19 nt, Homo sapiens
ggcuccggacgcugcugcc

SEQ ID NO: 51428 - RNA, 23 nt, Homo sapiens
ggcucugggauagcugacccagc

SEQ ID NO: 51429 - RNA, 15 nt, Homo sapiens
ggcugcgcucggccu

SEQ ID NO: 51430 - RNA, 17 nt, Homo sapiens
ggcugcgcucggccugc

SEQ ID NO: 51431 - RNA, 18 nt, Homo sapiens
ggcugcgcucggccugcu

SEQ ID NO: 51432 - RNA, 20 nt, Homo sapiens
ggcugcgcucggccugcucg

SEQ ID NO: 51433 - RNA, 21 nt, Homo sapiens
ggcugcgcucggccugcucgc

SEQ ID NO: 51434 - RNA, 15 nt, Homo sapiens
ggcugcugguggcgc

SEQ ID NO: 51435 - RNA, 19 nt, Homo sapiens
ggcugcugguggcgcuggc

SEQ ID NO: 51436 - RNA, 20 nt, Homo sapiens
ggcugcugguggcgcuggcu

SEQ ID NO: 51437 - RNA, 13 nt, Homo sapiens
ggcuggagcugcc

SEQ ID NO: 51438 - RNA, 17 nt, Homo sapiens
ggcuggagugcaguggc

SEQ ID NO: 51439 - RNA, 21 nt, Homo sapiens
ggcuggagugcaguggcgcaa

SEQ ID NO: 51440 - RNA, 13 nt, Homo sapiens
ggcuggcaccgcu

SEQ ID NO: 51441 - RNA, 14 nt, Homo sapiens
ggcuggcaccgcug

SEQ ID NO: 51442 - RNA, 15 nt, Homo sapiens
ggcuggcaccgcugu

SEQ ID NO: 51443 - RNA, 17 nt, Homo sapiens
ggcuggcaccgcuguac

SEQ ID NO: 51444 - RNA, 15 nt, Homo sapiens
ggcugggaguggcau

SEQ ID NO: 51445 - RNA, 12 nt, Homo sapiens
ggcuggucucga

SEQ ID NO: 51446 - RNA, 16 nt, Homo sapiens
ggcuggucucgaacug

SEQ ID NO: 51447 - RNA, 20 nt, Homo sapiens
ggcuggucucgaacugcugg

SEQ ID NO: 51448 - RNA, 20 nt, Homo sapiens
ggcuuagacccucaugcugc

SEQ ID NO: 51449 - RNA, 22 nt, Homo sapiens
ggcuuagacccucaugcugcca

SEQ ID NO: 51450 - RNA, 23 nt, Homo sapiens
ggcuuagacccucaugcugccaa

SEQ ID NO: 51451 - RNA, 15 nt, Homo sapiens
ggcuuccuggcaaua

SEQ ID NO: 51452 - RNA, 15 nt, Homo sapiens
ggcuugugugcacau

SEQ ID NO: 51453 - RNA, 19 nt, Homo sapiens
ggcuuuaaaacuuauccuc

SEQ ID NO: 51454 - RNA, 15 nt, Homo sapiens
ggcuuuaucucaggg

SEQ ID NO: 51455 - RNA, 15 nt, Homo sapiens
ggcuuucccaacagc

SEQ ID NO: 51456 - RNA, 13 nt, Homo sapiens
ggcuuuugugcau

SEQ ID NO: 51457 - RNA, 10 nt, Homo sapiens
gggaaacugc

SEQ ID NO: 51458 - RNA, 20 nt, Homo sapiens
gggaaagaagagccggagcc

SEQ ID NO: 51459 - RNA, 13 nt, Homo sapiens
gggaaagggcugu

SEQ ID NO: 51460 - RNA, 21 nt, Homo sapiens
gggaaugaagauacugaaaua

SEQ ID NO: 51461 - RNA, 20 nt, Homo sapiens
gggacacaggcuccaaacug

SEQ ID NO: 51462 - RNA, 11 nt, Homo sapiens
gggaccucucc

SEQ ID NO: 51463 - RNA, 18 nt, Homo sapiens
gggacuucugucuucaca

SEQ ID NO: 51464 - RNA, 18 nt, Homo sapiens
gggagaaccuagggugau

SEQ ID NO: 51465 - RNA, 19 nt, Homo sapiens
gggagcgagccccaggcgg

SEQ ID NO: 51466 - RNA, 20 nt, Homo sapiens
gggagcgagccccaggcggg

SEQ ID NO: 51467 - RNA, 14 nt, Homo sapiens
gggagcuuuuguag

SEQ ID NO: 51468 - RNA, 16 nt, Homo sapiens
gggaggggcgcucgcu

SEQ ID NO: 51469 - RNA, 11 nt, Homo sapiens
gggaguggcgc

SEQ ID NO: 51470 - RNA, 12 nt, Homo sapiens
gggaguggcgcg

SEQ ID NO: 51471 - RNA, 17 nt, Homo sapiens
gggaguggcgcgcgcca

SEQ ID NO: 51472 - RNA, 18 nt, Homo sapiens
gggaguggcgcgcgccac

SEQ ID NO: 51473 - RNA, 13 nt, Homo sapiens
gggcagugcuugg

SEQ ID NO: 51474 - RNA, 15 nt, Homo sapiens
gggcagugcuuggcc

SEQ ID NO: 51475 - RNA, 17 nt, Homo sapiens
gggcagugcuuggccca

SEQ ID NO: 51476 - RNA, 18 nt, Homo sapiens
gggcagugcuuggcccag

SEQ ID NO: 51477 - RNA, 19 nt, Homo sapiens
gggcagugcuuggcccagg

SEQ ID NO: 51478 - RNA, 20 nt, Homo sapiens
gggcagugcuuggcccagga

SEQ ID NO: 51479 - RNA, 17 nt, Homo sapiens
gggcauggguuuuauua

SEQ ID NO: 51480 - RNA, 18 nt, Homo sapiens
gggcauggguuuuauuau

SEQ ID NO: 51481 - RNA, 13 nt, Homo sapiens
gggccgacggagc

SEQ ID NO: 51482 - RNA, 19 nt, Homo sapiens
gggccgacggagccgggaa

SEQ ID NO: 51483 - RNA, 13 nt, Homo sapiens
gggccuggcuggg

SEQ ID NO: 51484 - RNA, 20 nt, Homo sapiens
gggccuggcugggaguggca

SEQ ID NO: 51485 - RNA, 12 nt, Homo sapiens
gggcgcggggcg

SEQ ID NO: 51486 - RNA, 13 nt, Homo sapiens
gggcgcggggcgg

SEQ ID NO: 51487 - RNA, 20 nt, Homo sapiens
gggcgcucgcuuccgcaucc

SEQ ID NO: 51488 - RNA, 21 nt, Homo sapiens
gggcgcucgcuuccgcauccu

SEQ ID NO: 51489 - RNA, 23 nt, Homo sapiens
gggcgcucgcuuccgcauccuag

SEQ ID NO: 51490 - RNA, 24 nt, Homo sapiens
gggcgcucgcuuccgcauccuagu

SEQ ID NO: 51491 - RNA, 10 nt, Homo sapiens
gggcggcggc

SEQ ID NO: 51492 - RNA, 11 nt, Homo sapiens
gggcggcggcc

SEQ ID NO: 51493 - RNA, 13 nt, Homo sapiens
gggcggcggcccu

SEQ ID NO: 51494 - RNA, 15 nt, Homo sapiens
gggcgggacacaggc

SEQ ID NO: 51495 - RNA, 16 nt, Homo sapiens
gggcggggagcgagcc

SEQ ID NO: 51496 - RNA, 11 nt, Homo sapiens
gggcuacgcgc

SEQ ID NO: 51497 - RNA, 12 nt, Homo sapiens
gggcuacgcgcg

SEQ ID NO: 51498 - RNA, 16 nt, Homo sapiens
gggcuacgcgcgcucc

SEQ ID NO: 51499 - RNA, 20 nt, Homo sapiens
gggcuacgcgcgcuccgcgc

SEQ ID NO: 51500 - RNA, 17 nt, Homo sapiens
gggcuuuagggaccugc

SEQ ID NO: 51501 - RNA, 13 nt, Homo sapiens
ggggaggggcgcu

SEQ ID NO: 51502 - RNA, 15 nt, Homo sapiens
ggggaggggcgcucg

SEQ ID NO: 51503 - RNA, 21 nt, Homo sapiens
ggggcagugcuuggcccagga

SEQ ID NO: 51504 - RNA, 16 nt, Homo sapiens
ggggccaugaaucacc

SEQ ID NO: 51505 - RNA, 17 nt, Homo sapiens
ggggcgcucgcuuccgc

SEQ ID NO: 51506 - RNA, 10 nt, Homo sapiens
ggggcggcgg

SEQ ID NO: 51507 - RNA, 11 nt, Homo sapiens
ggggcggcggc

SEQ ID NO: 51508 - RNA, 15 nt, Homo sapiens
ggggcggcggcccug

SEQ ID NO: 51509 - RNA, 17 nt, Homo sapiens
ggggcggggagcgagcc

SEQ ID NO: 51510 - RNA, 14 nt, Homo sapiens
ggggcugaugcagu

SEQ ID NO: 51511 - RNA, 15 nt, Homo sapiens
ggggcugaugcaguu

SEQ ID NO: 51512 - RNA, 10 nt, Homo sapiens
ggggcuuccu

SEQ ID NO: 51513 - RNA, 20 nt, Homo sapiens
ggggcuuuagggaccugcug

SEQ ID NO: 51514 - RNA, 16 nt, Homo sapiens
gggguggguggggcag

SEQ ID NO: 51515 - RNA, 19 nt, Homo sapiens
gggguggguggggcagugc

SEQ ID NO: 51516 - RNA, 15 nt, Homo sapiens
ggguaauaagagcag

SEQ ID NO: 51517 - RNA, 22 nt, Homo sapiens
ggguaauaagagcaguagcagc

SEQ ID NO: 51518 - RNA, 20 nt, Homo sapiens
ggguagcauuuguguugaag

SEQ ID NO: 51519 - RNA, 23 nt, Homo sapiens
gggucgcaggaccaucccggccg

SEQ ID NO: 51520 - RNA, 11 nt, Homo sapiens
gggucgccggc

SEQ ID NO: 51521 - RNA, 12 nt, Homo sapiens
gggucgccggca

SEQ ID NO: 51522 - RNA, 15 nt, Homo sapiens
gggucucaguguccu

SEQ ID NO: 51523 - RNA, 11 nt, Homo sapiens
gggugaacugc

SEQ ID NO: 51524 - RNA, 15 nt, Homo sapiens
gggugaacugcagcg

SEQ ID NO: 51525 - RNA, 13 nt, Homo sapiens
gggugagggcuug

SEQ ID NO: 51526 - RNA, 13 nt, Homo sapiens
ggguggggcagug

SEQ ID NO: 51527 - RNA, 13 nt, Homo sapiens
ggguggguggggc

SEQ ID NO: 51528 - RNA, 20 nt, Homo sapiens
gguagcuaaauauauauuuu

SEQ ID NO: 51529 - RNA, 22 nt, Homo sapiens
gguauauaaauuuucccaaaac

SEQ ID NO: 51530 - RNA, 17 nt, Homo sapiens
ggucacuuuacuguccc

SEQ ID NO: 51531 - RNA, 22 nt, Homo sapiens
ggucaggaguuccuaaccagcc

SEQ ID NO: 51532 - RNA, 14 nt, Homo sapiens
gguccgggucgcag

SEQ ID NO: 51533 - RNA, 17 nt, Homo sapiens
gguccgggucgcaggac

SEQ ID NO: 51534 - RNA, 19 nt, Homo sapiens
gguccgggucgcaggacca

SEQ ID NO: 51535 - RNA, 22 nt, Homo sapiens
gguccuaagucccugcugcccu

SEQ ID NO: 51536 - RNA, 23 nt, Homo sapiens
gguccuaagucccugcugcccuu

SEQ ID NO: 51537 - RNA, 13 nt, Homo sapiens
ggucgcaggacca

SEQ ID NO: 51538 - RNA, 20 nt, Homo sapiens
ggucgcaggaccaucccggc

SEQ ID NO: 51539 - RNA, 21 nt, Homo sapiens
ggucgcaggaccaucccggcc

SEQ ID NO: 51540 - RNA, 11 nt, Homo sapiens
ggucgccggca

SEQ ID NO: 51541 - RNA, 16 nt, Homo sapiens
ggucgccggcaucuuc

SEQ ID NO: 51542 - RNA, 12 nt, Homo sapiens
ggucggguuuua

SEQ ID NO: 51543 - RNA, 19 nt, Homo sapiens
ggucuaccuguucgcgcgc

SEQ ID NO: 51544 - RNA, 20 nt, Homo sapiens
ggucuaccuguucgcgcgcc

SEQ ID NO: 51545 - RNA, 21 nt, Homo sapiens
ggucuaccuguucgcgcgccu

SEQ ID NO: 51546 - RNA, 23 nt, Homo sapiens
ggucuaccuguucgcgcgccucc

SEQ ID NO: 51547 - RNA, 16 nt, Homo sapiens
ggucucaguguccuca

SEQ ID NO: 51548 - RNA, 14 nt, Homo sapiens
ggucucgaacugcu

SEQ ID NO: 51549 - RNA, 16 nt, Homo sapiens
ggucucgaacugcugg

SEQ ID NO: 51550 - RNA, 17 nt, Homo sapiens
ggucucgaacugcugga

SEQ ID NO: 51551 - RNA, 18 nt, Homo sapiens
ggucucgaacugcuggau

SEQ ID NO: 51552 - RNA, 14 nt, Homo sapiens
ggugacagagcaag

SEQ ID NO: 51553 - RNA, 22 nt, Homo sapiens
ggugacccugaugaaaacauag

SEQ ID NO: 51554 - RNA, 24 nt, Homo sapiens
ggugaucucauuuaauccucucaa

SEQ ID NO: 51555 - RNA, 12 nt, Homo sapiens
gguggcgcuggc

SEQ ID NO: 51556 - RNA, 13 nt, Homo sapiens
gguggcgcuggcu

SEQ ID NO: 51557 - RNA, 14 nt, Homo sapiens
gguggcgcuggcug

SEQ ID NO: 51558 - RNA, 15 nt, Homo sapiens
gguggcgcuggcugc

SEQ ID NO: 51559 - RNA, 19 nt, Homo sapiens
gguggcgcuggcugcgcuc

SEQ ID NO: 51560 - RNA, 20 nt, Homo sapiens
gguggcgcuggcugcgcucg

SEQ ID NO: 51561 - RNA, 22 nt, Homo sapiens
gguggcgcuggcugcgcucggc

SEQ ID NO: 51562 - RNA, 15 nt, Homo sapiens
gguggcucacgccug

SEQ ID NO: 51563 - RNA, 16 nt, Homo sapiens
gguggcucacgccugu

SEQ ID NO: 51564 - RNA, 22 nt, Homo sapiens
gguggcuguuccugaaggaggc

SEQ ID NO: 51565 - RNA, 17 nt, Homo sapiens
gguggggcagugcuugg

SEQ ID NO: 51566 - RNA, 14 nt, Homo sapiens
ggugggugggguga

SEQ ID NO: 51567 - RNA, 16 nt, Homo sapiens
ggugguuucagaaaug

SEQ ID NO: 51568 - RNA, 15 nt, Homo sapiens
gguucuaggccgggc

SEQ ID NO: 51569 - RNA, 16 nt, Homo sapiens
gguucuaggccgggcg

SEQ ID NO: 51570 - RNA, 17 nt, Homo sapiens
gguucuaggccgggcgc

SEQ ID NO: 51571 - RNA, 15 nt, Homo sapiens
gguugcagugagccg

SEQ ID NO: 51572 - RNA, 19 nt, Homo sapiens
gguugcuuuaauaucauca

SEQ ID NO: 51573 - RNA, 15 nt, Homo sapiens
gguuugccaugcugg

SEQ ID NO: 51574 - RNA, 16 nt, Homo sapiens
gguuugccaugcuggc

SEQ ID NO: 51575 - RNA, 19 nt, Homo sapiens
gguuuuucaguuuucagga

SEQ ID NO: 51576 - RNA, 18 nt, Homo sapiens
guaaaauggugugaccac

SEQ ID NO: 51577 - RNA, 21 nt, Homo sapiens
guaaaauugaaaggcauucuc

SEQ ID NO: 51578 - RNA, 23 nt, Homo sapiens
guaaaauugaaaggcauucucug

SEQ ID NO: 51579 - RNA, 15 nt, Homo sapiens
guaaacggucucuca

SEQ ID NO: 51580 - RNA, 17 nt, Homo sapiens
guaaacggucucucacu

SEQ ID NO: 51581 - RNA, 17 nt, Homo sapiens
guaaagcuuugugcaga

SEQ ID NO: 51582 - RNA, 13 nt, Homo sapiens
guaaaggcaaacu

SEQ ID NO: 51583 - RNA, 14 nt, Homo sapiens
guaaaggcaaacuu

SEQ ID NO: 51584 - RNA, 16 nt, Homo sapiens
guaaauagcuaagaua

SEQ ID NO: 51585 - RNA, 19 nt, Homo sapiens
guaaauagcuaagauauaa

SEQ ID NO: 51586 - RNA, 21 nt, Homo sapiens
guaaaugggggugcauuugag

SEQ ID NO: 51587 - RNA, 22 nt, Homo sapiens
guaacaacaauuauuugaagau

SEQ ID NO: 51588 - RNA, 15 nt, Homo sapiens
guaacugacaacuug

SEQ ID NO: 51589 - RNA, 21 nt, Homo sapiens
guaacuguaaagaugaauguc

SEQ ID NO: 51590 - RNA, 23 nt, Homo sapiens
guaacuguaaagaugaaugucag

SEQ ID NO: 51591 - RNA, 15 nt, Homo sapiens
guaaggggaauugag

SEQ ID NO: 51592 - RNA, 19 nt, Homo sapiens
guaaguaaacggucucuca

SEQ ID NO: 51593 - RNA, 21 nt, Homo sapiens
guaaguuuaugcauacaguaa

SEQ ID NO: 51594 - RNA, 16 nt, Homo sapiens
guaaucccagcacuuu

SEQ ID NO: 51595 - RNA, 20 nt, Homo sapiens
guaaucccagcuacuuggga

SEQ ID NO: 51596 - RNA, 22 nt, Homo sapiens
guaauuauauaguuacccaaau

SEQ ID NO: 51597 - RNA, 21 nt, Homo sapiens
guacacuguuucaaacuuuac

SEQ ID NO: 51598 - RNA, 13 nt, Homo sapiens
guacaucaaugau

SEQ ID NO: 51599 - RNA, 21 nt, Homo sapiens
guacauccauggugugcuggc

SEQ ID NO: 51600 - RNA, 22 nt, Homo sapiens
guacauccauggugugcuggcu

SEQ ID NO: 51601 - RNA, 21 nt, Homo sapiens
guacauuuccaaauucacaag

SEQ ID NO: 51602 - RNA, 13 nt, Homo sapiens
guaccauaauucu

SEQ ID NO: 51603 - RNA, 22 nt, Homo sapiens
guaccuaacgaaguauccuuca

SEQ ID NO: 51604 - RNA, 23 nt, Homo sapiens
guaccucugcuauuugcuguuau

SEQ ID NO: 51605 - RNA, 13 nt, Homo sapiens
guacgcgagcgcg

SEQ ID NO: 51606 - RNA, 14 nt, Homo sapiens
guacgcgagcgcgc

SEQ ID NO: 51607 - RNA, 15 nt, Homo sapiens
guacgcgagcgcgcg

SEQ ID NO: 51608 - RNA, 16 nt, Homo sapiens
guacgcgagcgcgcgc

SEQ ID NO: 51609 - RNA, 17 nt, Homo sapiens
guacgcgagcgcgcgcg

SEQ ID NO: 51610 - RNA, 20 nt, Homo sapiens
guacgcgagcgcgcgcgccc

SEQ ID NO: 51611 - RNA, 21 nt, Homo sapiens
guacgcgagcgcgcgcgcccu

SEQ ID NO: 51612 - RNA, 17 nt, Homo sapiens
guacguugugcauuugg

SEQ ID NO: 51613 - RNA, 13 nt, Homo sapiens
guacuccagccug

SEQ ID NO: 51614 - RNA, 14 nt, Homo sapiens
guacuccagccugg

SEQ ID NO: 51615 - RNA, 20 nt, Homo sapiens
guacuccagccugggugaca

SEQ ID NO: 51616 - RNA, 23 nt, Homo sapiens
guagaaaaagcaguaacugacaa

SEQ ID NO: 51617 - RNA, 19 nt, Homo sapiens
guagaaaagggaacugaac

SEQ ID NO: 51618 - RNA, 15 nt, Homo sapiens
guagaauauauuucc

SEQ ID NO: 51619 - RNA, 16 nt, Homo sapiens
guagaauauauuuccu

SEQ ID NO: 51620 - RNA, 21 nt, Homo sapiens
guagaauguuuucaaauguuc

SEQ ID NO: 51621 - RNA, 21 nt, Homo sapiens
guagaggguguguaaguagau

SEQ ID NO: 51622 - RNA, 15 nt, Homo sapiens
guagauaugaggcau

SEQ ID NO: 51623 - RNA, 14 nt, Homo sapiens
guagcaaauuccaa

SEQ ID NO: 51624 - RNA, 14 nt, Homo sapiens
guagcagcucauaa

SEQ ID NO: 51625 - RNA, 15 nt, Homo sapiens
guagccacuucacuu

SEQ ID NO: 51626 - RNA, 16 nt, Homo sapiens
guagccacuucacuuu

SEQ ID NO: 51627 - RNA, 22 nt, Homo sapiens
guagcucucugaccuccuccuu

SEQ ID NO: 51628 - RNA, 22 nt, Homo sapiens
guaggugacuauuauauuucca

SEQ ID NO: 51629 - RNA, 13 nt, Homo sapiens
guaguuagcuuuc

SEQ ID NO: 51630 - RNA, 11 nt, Homo sapiens
guauauucaaa

SEQ ID NO: 51631 - RNA, 17 nt, Homo sapiens
guauccuucagccugaa

SEQ ID NO: 51632 - RNA, 16 nt, Homo sapiens
guaugacgugacuggc

SEQ ID NO: 51633 - RNA, 12 nt, Homo sapiens
guauggcaaacu

SEQ ID NO: 51634 - RNA, 14 nt, Homo sapiens
guauggcagcuuuc

SEQ ID NO: 51635 - RNA, 11 nt, Homo sapiens
guauguuuuca

SEQ ID NO: 51636 - RNA, 15 nt, Homo sapiens
guauuaaguuguuaa

SEQ ID NO: 51637 - RNA, 14 nt, Homo sapiens
guauuauaccuuuu

SEQ ID NO: 51638 - RNA, 21 nt, Homo sapiens
guauugcauuuaauuuauuga

SEQ ID NO: 51639 - RNA, 20 nt, Homo sapiens
guauuuuaaaagaaugauua

SEQ ID NO: 51640 - RNA, 16 nt, Homo sapiens
guauuuuacuuuucca

SEQ ID NO: 51641 - RNA, 23 nt, Homo sapiens
guauuuuauuacaucuuucacau

SEQ ID NO: 51642 - RNA, 15 nt, Homo sapiens
guauuuucagcagag

SEQ ID NO: 51643 - RNA, 17 nt, Homo sapiens
guauuuuuuuacuaaua

SEQ ID NO: 51644 - RNA, 12 nt, Homo sapiens
gucaacauuucu

SEQ ID NO: 51645 - RNA, 22 nt, Homo sapiens
gucaaccccaaguuaguucaau

SEQ ID NO: 51646 - RNA, 19 nt, Homo sapiens
gucaaggcuuagacccuca

SEQ ID NO: 51647 - RNA, 14 nt, Homo sapiens
gucaaugcagcccc

SEQ ID NO: 51648 - RNA, 23 nt, Homo sapiens
gucacacaaccugucccagcgag

SEQ ID NO: 51649 - RNA, 12 nt, Homo sapiens
gucacauuccaa

SEQ ID NO: 51650 - RNA, 18 nt, Homo sapiens
gucacuuuacugucccca

SEQ ID NO: 51651 - RNA, 19 nt, Homo sapiens
gucacuuuacuguccccau

SEQ ID NO: 51652 - RNA, 16 nt, Homo sapiens
gucagaagaccugguc

SEQ ID NO: 51653 - RNA, 23 nt, Homo sapiens
gucaggaguuccuaaccagccug

SEQ ID NO: 51654 - RNA, 19 nt, Homo sapiens
gucagugcccaacuguuau

SEQ ID NO: 51655 - RNA, 14 nt, Homo sapiens
gucauuauguuaau

SEQ ID NO: 51656 - RNA, 14 nt, Homo sapiens
gucauuguucuugu

SEQ ID NO: 51657 - RNA, 14 nt, Homo sapiens
gucauuuuuuuuaa

SEQ ID NO: 51658 - RNA, 15 nt, Homo sapiens
guccaagcauaccaa

SEQ ID NO: 51659 - RNA, 14 nt, Homo sapiens
guccccagagcuac

SEQ ID NO: 51660 - RNA, 24 nt, Homo sapiens
gucccuagcccuuacguccuucca

SEQ ID NO: 51661 - RNA, 11 nt, Homo sapiens
gucccugcugc

SEQ ID NO: 51662 - RNA, 12 nt, Homo sapiens
gucccugcugcc

SEQ ID NO: 51663 - RNA, 14 nt, Homo sapiens
gucccugcugcccu

SEQ ID NO: 51664 - RNA, 15 nt, Homo sapiens
guccgcuauccacca

SEQ ID NO: 51665 - RNA, 16 nt, Homo sapiens
guccgggucgcaggac

SEQ ID NO: 51666 - RNA, 18 nt, Homo sapiens
guccgggucgcaggacca

SEQ ID NO: 51667 - RNA, 21 nt, Homo sapiens
guccgggucgcaggaccaucc

SEQ ID NO: 51668 - RNA, 19 nt, Homo sapiens
guccuaagucccugcugcc

SEQ ID NO: 51669 - RNA, 17 nt, Homo sapiens
gucgcaggaccaucccg

SEQ ID NO: 51670 - RNA, 18 nt, Homo sapiens
gucgcaggaccaucccgg

SEQ ID NO: 51671 - RNA, 19 nt, Homo sapiens
gucgcaggaccaucccggc

SEQ ID NO: 51672 - RNA, 21 nt, Homo sapiens
gucgcaggaccaucccggccg

SEQ ID NO: 51673 - RNA, 23 nt, Homo sapiens
gucgcaggaccaucccggccggc

SEQ ID NO: 51674 - RNA, 13 nt, Homo sapiens
gucgccggcaucu

SEQ ID NO: 51675 - RNA, 15 nt, Homo sapiens
gucggaaaacaugcu

SEQ ID NO: 51676 - RNA, 22 nt, Homo sapiens
gucuaccaaaaaucucaauauu

SEQ ID NO: 51677 - RNA, 15 nt, Homo sapiens
gucuaccuguucgcg

SEQ ID NO: 51678 - RNA, 16 nt, Homo sapiens
gucuaccuguucgcgc

SEQ ID NO: 51679 - RNA, 17 nt, Homo sapiens
gucuaccuguucgcgcg

SEQ ID NO: 51680 - RNA, 20 nt, Homo sapiens
gucuaccuguucgcgcgccu

SEQ ID NO: 51681 - RNA, 21 nt, Homo sapiens
gucuaccuguucgcgcgccuc

SEQ ID NO: 51682 - RNA, 21 nt, Homo sapiens
gucuauuuacggaacucaaau

SEQ ID NO: 51683 - RNA, 21 nt, Homo sapiens
gucucagugucaaugcagccc

SEQ ID NO: 51684 - RNA, 22 nt, Homo sapiens
gucucaguguccucaucuguaa

SEQ ID NO: 51685 - RNA, 17 nt, Homo sapiens
gucucccaaagugcugg

SEQ ID NO: 51686 - RNA, 18 nt, Homo sapiens
gucucccaaagugcuggg

SEQ ID NO: 51687 - RNA, 15 nt, Homo sapiens
gucucgaacugcugg

SEQ ID NO: 51688 - RNA, 16 nt, Homo sapiens
gucucgaacugcugga

SEQ ID NO: 51689 - RNA, 17 nt, Homo sapiens
gucucgaacugcuggau

SEQ ID NO: 51690 - RNA, 18 nt, Homo sapiens
gucucgaacugcuggauu

SEQ ID NO: 51691 - RNA, 15 nt, Homo sapiens
gucucuaucauuaaa

SEQ ID NO: 51692 - RNA, 19 nt, Homo sapiens
gucucugaagugaaacugc

SEQ ID NO: 51693 - RNA, 22 nt, Homo sapiens
gucuuguguuucuuuaguuuuu

SEQ ID NO: 51694 - RNA, 15 nt, Homo sapiens
gugaaagaggcagcu

SEQ ID NO: 51695 - RNA, 24 nt, Homo sapiens
gugaacaaauuuacagagacagaa

SEQ ID NO: 51696 - RNA, 23 nt, Homo sapiens
gugaagacaaugacuuacuguac

SEQ ID NO: 51697 - RNA, 23 nt, Homo sapiens
gugaauuuuucucuaacucagaa

SEQ ID NO: 51698 - RNA, 14 nt, Homo sapiens
gugacccugaugaa

SEQ ID NO: 51699 - RNA, 12 nt, Homo sapiens
gugacuggccug

SEQ ID NO: 51700 - RNA, 18 nt, Homo sapiens
gugacuggccugcuggau

SEQ ID NO: 51701 - RNA, 16 nt, Homo sapiens
gugacuuaguguacau

SEQ ID NO: 51702 - RNA, 18 nt, Homo sapiens
gugagacagcucugcaua

SEQ ID NO: 51703 - RNA, 16 nt, Homo sapiens
gugagcaucacaguuu

SEQ ID NO: 51704 - RNA, 22 nt, Homo sapiens
gugauccgcccaucuccgucuc

SEQ ID NO: 51705 - RNA, 20 nt, Homo sapiens
gugaugacauaucacauguc

SEQ ID NO: 51706 - RNA, 19 nt, Homo sapiens
gugauuacccucugggucu

SEQ ID NO: 51707 - RNA, 21 nt, Homo sapiens
gugauuacccucugggucuca

SEQ ID NO: 51708 - RNA, 17 nt, Homo sapiens
gugauucccuccugcua

SEQ ID NO: 51709 - RNA, 18 nt, Homo sapiens
gugauucccuccugcuac

SEQ ID NO: 51710 - RNA, 12 nt, Homo sapiens
gugauuuuugua

SEQ ID NO: 51711 - RNA, 14 nt, Homo sapiens
gugcacuaaugugu

SEQ ID NO: 51712 - RNA, 14 nt, Homo sapiens
gugcauauuuuauu

SEQ ID NO: 51713 - RNA, 16 nt, Homo sapiens
gugcauauuuuauuau

SEQ ID NO: 51714 - RNA, 17 nt, Homo sapiens
gugccaguuauggcuau

SEQ ID NO: 51715 - RNA, 17 nt, Homo sapiens
gugccucaccccuugcc

SEQ ID NO: 51716 - RNA, 16 nt, Homo sapiens
gugccuguaaucacag

SEQ ID NO: 51717 - RNA, 12 nt, Homo sapiens
gugcggccuggu

SEQ ID NO: 51718 - RNA, 13 nt, Homo sapiens
gugcggccugguc

SEQ ID NO: 51719 - RNA, 13 nt, Homo sapiens
gugcuacaaaaac

SEQ ID NO: 51720 - RNA, 23 nt, Homo sapiens
gugcugggaauuacaggcgugag

SEQ ID NO: 51721 - RNA, 24 nt, Homo sapiens
gugcugggaauuacaggcgugagc

SEQ ID NO: 51722 - RNA, 13 nt, Homo sapiens
gugcuuggcccag

SEQ ID NO: 51723 - RNA, 16 nt, Homo sapiens
gugcuuggcccaggag

SEQ ID NO: 51724 - RNA, 18 nt, Homo sapiens
gugcuuggcccaggaguu

SEQ ID NO: 51725 - RNA, 21 nt, Homo sapiens
gugcuuuccguggcacugcau

SEQ ID NO: 51726 - RNA, 21 nt, Homo sapiens
guggagggggcgcgugcaggc

SEQ ID NO: 51727 - RNA, 15 nt, Homo sapiens
guggaugauguuucg

SEQ ID NO: 51728 - RNA, 18 nt, Homo sapiens
guggcauguaugacguga

SEQ ID NO: 51729 - RNA, 15 nt, Homo sapiens
guggcauuuucacuu

SEQ ID NO: 51730 - RNA, 16 nt, Homo sapiens
guggcauuuucacuuu

SEQ ID NO: 51731 - RNA, 14 nt, Homo sapiens
guggcgacucuaua

SEQ ID NO: 51732 - RNA, 13 nt, Homo sapiens
guggcgcgcgcca

SEQ ID NO: 51733 - RNA, 11 nt, Homo sapiens
guggcgcuggc

SEQ ID NO: 51734 - RNA, 12 nt, Homo sapiens
guggcgcuggcu

SEQ ID NO: 51735 - RNA, 13 nt, Homo sapiens
guggcgcuggcug

SEQ ID NO: 51736 - RNA, 16 nt, Homo sapiens
guggcgcuggcugcgc

SEQ ID NO: 51737 - RNA, 23 nt, Homo sapiens
guggcgcuggcugcgcucggccu

SEQ ID NO: 51738 - RNA, 22 nt, Homo sapiens
gugggacagucaccucauggaa

SEQ ID NO: 51739 - RNA, 23 nt, Homo sapiens
gugggacaguuccugagaccagc

SEQ ID NO: 51740 - RNA, 15 nt, Homo sapiens
gugggaccugggcca

SEQ ID NO: 51741 - RNA, 16 nt, Homo sapiens
gugggagaauucuuac

SEQ ID NO: 51742 - RNA, 21 nt, Homo sapiens
gugggauacuauuuaauuauu

SEQ ID NO: 51743 - RNA, 10 nt, Homo sapiens
gugggcucug

SEQ ID NO: 51744 - RNA, 13 nt, Homo sapiens
guggggcagugcu

SEQ ID NO: 51745 - RNA, 16 nt, Homo sapiens
guggggcagugcuugg

SEQ ID NO: 51746 - RNA, 18 nt, Homo sapiens
guggggcagugcuuggcc

SEQ ID NO: 51747 - RNA, 14 nt, Homo sapiens
guggguagacacac

SEQ ID NO: 51748 - RNA, 13 nt, Homo sapiens
guggguggggcag

SEQ ID NO: 51749 - RNA, 16 nt, Homo sapiens
guggguggggcagugc

SEQ ID NO: 51750 - RNA, 13 nt, Homo sapiens
gugggugggguga

SEQ ID NO: 51751 - RNA, 21 nt, Homo sapiens
gugguuauuuagggaacugcu

SEQ ID NO: 51752 - RNA, 15 nt, Homo sapiens
gugguuucagaaaug

SEQ ID NO: 51753 - RNA, 12 nt, Homo sapiens
gugucaggugac

SEQ ID NO: 51754 - RNA, 16 nt, Homo sapiens
gugucaguggaugcug

SEQ ID NO: 51755 - RNA, 20 nt, Homo sapiens
gugucuggcacuugggacaa

SEQ ID NO: 51756 - RNA, 13 nt, Homo sapiens
gugugaggaaaac

SEQ ID NO: 51757 - RNA, 20 nt, Homo sapiens
gugugauuuggggauauuuu

SEQ ID NO: 51758 - RNA, 14 nt, Homo sapiens
gugugggcaauguu

SEQ ID NO: 51759 - RNA, 20 nt, Homo sapiens
guguuggaaaaugugcaaua

SEQ ID NO: 51760 - RNA, 18 nt, Homo sapiens
guguuuuucacauuugcg

SEQ ID NO: 51761 - RNA, 23 nt, Homo sapiens
guuaauauuucuucgugaugaca

SEQ ID NO: 51762 - RNA, 19 nt, Homo sapiens
guuaaucuuucaaaguguc

SEQ ID NO: 51763 - RNA, 15 nt, Homo sapiens
guuacaacacggacg

SEQ ID NO: 51764 - RNA, 22 nt, Homo sapiens
guuaccaguaacggaacaguau

SEQ ID NO: 51765 - RNA, 18 nt, Homo sapiens
guuagagaauuuccuuac

SEQ ID NO: 51766 - RNA, 17 nt, Homo sapiens
guuauaaucuuucacag

SEQ ID NO: 51767 - RNA, 19 nt, Homo sapiens
guuaugauuaaguaaugau

SEQ ID NO: 51768 - RNA, 19 nt, Homo sapiens
guuaugcauaaagucagug

SEQ ID NO: 51769 - RNA, 12 nt, Homo sapiens
guuauuuauaau

SEQ ID NO: 51770 - RNA, 19 nt, Homo sapiens
guuauuuauaaucacuuuu

SEQ ID NO: 51771 - RNA, 20 nt, Homo sapiens
guuauuuauaaucacuuuuu

SEQ ID NO: 51772 - RNA, 21 nt, Homo sapiens
guuauuuauaaucacuuuuuu

SEQ ID NO: 51773 - RNA, 17 nt, Homo sapiens
guuauuuuaucugcuau

SEQ ID NO: 51774 - RNA, 22 nt, Homo sapiens
guuauuuuaucugcuaugcuau

SEQ ID NO: 51775 - RNA, 23 nt, Homo sapiens
guuauuuuaucugcuaugcuauu

SEQ ID NO: 51776 - RNA, 17 nt, Homo sapiens
guuauuuuuaaacugua

SEQ ID NO: 51777 - RNA, 21 nt, Homo sapiens
guuauuuuuaauuugguuuuc

SEQ ID NO: 51778 - RNA, 23 nt, Homo sapiens
guuauuuuuaauuugguuuucac

SEQ ID NO: 51779 - RNA, 15 nt, Homo sapiens
guucaaagauauuuu

SEQ ID NO: 51780 - RNA, 12 nt, Homo sapiens
guucaaauguug

SEQ ID NO: 51781 - RNA, 17 nt, Homo sapiens
guucaugaaagauucaa

SEQ ID NO: 51782 - RNA, 18 nt, Homo sapiens
guucaugaaagauucaau

SEQ ID NO: 51783 - RNA, 16 nt, Homo sapiens
guucccgugugccuga

SEQ ID NO: 51784 - RNA, 17 nt, Homo sapiens
guucccuugaugaagaa

SEQ ID NO: 51785 - RNA, 16 nt, Homo sapiens
guuccuaaccagccug

SEQ ID NO: 51786 - RNA, 17 nt, Homo sapiens
guuccuaaccagccugg

SEQ ID NO: 51787 - RNA, 14 nt, Homo sapiens
guuccucgccacgc

SEQ ID NO: 51788 - RNA, 15 nt, Homo sapiens
guuccucgccacgcu

SEQ ID NO: 51789 - RNA, 16 nt, Homo sapiens
guuccugagaccagcc

SEQ ID NO: 51790 - RNA, 17 nt, Homo sapiens
guuccugagaccagcca

SEQ ID NO: 51791 - RNA, 23 nt, Homo sapiens
guuccugagaccagccaaccugg

SEQ ID NO: 51792 - RNA, 18 nt, Homo sapiens
guuccuucacauccugug

SEQ ID NO: 51793 - RNA, 14 nt, Homo sapiens
guucgcgcgccucc

SEQ ID NO: 51794 - RNA, 15 nt, Homo sapiens
guucgcgcgccuccg

SEQ ID NO: 51795 - RNA, 17 nt, Homo sapiens
guucgcgcgccuccgcu

SEQ ID NO: 51796 - RNA, 16 nt, Homo sapiens
guucuauaacaacaac

SEQ ID NO: 51797 - RNA, 22 nt, Homo sapiens
guucuauaacaacaacaacaaa

SEQ ID NO: 51798 - RNA, 21 nt, Homo sapiens
guucuccagucauuauguuaa

SEQ ID NO: 51799 - RNA, 12 nt, Homo sapiens
guucugaagaag

SEQ ID NO: 51800 - RNA, 13 nt, Homo sapiens
guucugaagaaga

SEQ ID NO: 51801 - RNA, 20 nt, Homo sapiens
guucuucuuggucucagugu

SEQ ID NO: 51802 - RNA, 16 nt, Homo sapiens
guucuuuggggagcca

SEQ ID NO: 51803 - RNA, 22 nt, Homo sapiens
guugaccaauaaccaugcccaa

SEQ ID NO: 51804 - RNA, 13 nt, Homo sapiens
guugauggaaaua

SEQ ID NO: 51805 - RNA, 14 nt, Homo sapiens
guugauggaaauac

SEQ ID NO: 51806 - RNA, 23 nt, Homo sapiens
guugauuucagcaccuacagugu

SEQ ID NO: 51807 - RNA, 16 nt, Homo sapiens
guugcagcccugcugc

SEQ ID NO: 51808 - RNA, 18 nt, Homo sapiens
guugcagcccugcugcug

SEQ ID NO: 51809 - RNA, 19 nt, Homo sapiens
guugcagcccugcugcugc

SEQ ID NO: 51810 - RNA, 20 nt, Homo sapiens
guugcagcccugcugcugcc

SEQ ID NO: 51811 - RNA, 23 nt, Homo sapiens
guugcagcccugcugcugccugc

SEQ ID NO: 51812 - RNA, 13 nt, Homo sapiens
guugccaaggcug

SEQ ID NO: 51813 - RNA, 14 nt, Homo sapiens
guugccaaggcugg

SEQ ID NO: 51814 - RNA, 16 nt, Homo sapiens
guugccaaggcuggag

SEQ ID NO: 51815 - RNA, 15 nt, Homo sapiens
guugcuguaugucuc

SEQ ID NO: 51816 - RNA, 14 nt, Homo sapiens
guuggaggcugcaa

SEQ ID NO: 51817 - RNA, 15 nt, Homo sapiens
guuggaggcugcaaa

SEQ ID NO: 51818 - RNA, 23 nt, Homo sapiens
guuguucucuucuuuaaagggau

SEQ ID NO: 51819 - RNA, 13 nt, Homo sapiens
guuguuggaggcu

SEQ ID NO: 51820 - RNA, 19 nt, Homo sapiens
guuguuggauaaaucagug

SEQ ID NO: 51821 - RNA, 15 nt, Homo sapiens
guuuaaaaucauuuc

SEQ ID NO: 51822 - RNA, 18 nt, Homo sapiens
guuuaaugggcacagggu

SEQ ID NO: 51823 - RNA, 15 nt, Homo sapiens
guuuagcagauuuaa

SEQ ID NO: 51824 - RNA, 23 nt, Homo sapiens
guuuagcauaguaccucugcuau

SEQ ID NO: 51825 - RNA, 15 nt, Homo sapiens
guuuaugauuccacc

SEQ ID NO: 51826 - RNA, 20 nt, Homo sapiens
guuuaugcauagauaaucuc

SEQ ID NO: 51827 - RNA, 17 nt, Homo sapiens
guuucauaagaauucug

SEQ ID NO: 51828 - RNA, 18 nt, Homo sapiens
guuucauaagaauucugu

SEQ ID NO: 51829 - RNA, 18 nt, Homo sapiens
guuuccauagggugacac

SEQ ID NO: 51830 - RNA, 23 nt, Homo sapiens
guuuccuagcacacacuuuuggu

SEQ ID NO: 51831 - RNA, 17 nt, Homo sapiens
guuuccuagcgcagcca

SEQ ID NO: 51832 - RNA, 23 nt, Homo sapiens
guuuccuagcgcagccaugugau

SEQ ID NO: 51833 - RNA, 16 nt, Homo sapiens
guuucuaugacacaug

SEQ ID NO: 51834 - RNA, 22 nt, Homo sapiens
guuugcauaggugaucucauuu

SEQ ID NO: 51835 - RNA, 20 nt, Homo sapiens
guuugccaugcuggccaggc

SEQ ID NO: 51836 - RNA, 23 nt, Homo sapiens
guuugccaugcuggccaggcugg

SEQ ID NO: 51837 - RNA, 13 nt, Homo sapiens
guuugcuaagcau

SEQ ID NO: 51838 - RNA, 19 nt, Homo sapiens
guuuggacaaaauggaaua

SEQ ID NO: 51839 - RNA, 20 nt, Homo sapiens
guuuggccagaagucaaggc

SEQ ID NO: 51840 - RNA, 14 nt, Homo sapiens
guuugugauugcca

SEQ ID NO: 51841 - RNA, 21 nt, Homo sapiens
guuuuacaguguuucuggcuu

SEQ ID NO: 51842 - RNA, 20 nt, Homo sapiens
guuuuaggaauacauaaagu

SEQ ID NO: 51843 - RNA, 13 nt, Homo sapiens
guuuucugacuaa

SEQ ID NO: 51844 - RNA, 20 nt, Homo sapiens
guuuugcaagccagauuuuc

SEQ ID NO: 51845 - RNA, 14 nt, Homo sapiens
guuuuuaagcuguu

SEQ ID NO: 51846 - RNA, 15 nt, Homo sapiens
guuuuuaagcuguuu

SEQ ID NO: 51847 - RNA, 23 nt, Homo sapiens
guuuuuauggcuuuugugcauua

SEQ ID NO: 51848 - RNA, 12 nt, Homo sapiens
guuuuucacauu

SEQ ID NO: 51849 - RNA, 18 nt, Homo sapiens
guuuuuccacuacugcua

SEQ ID NO: 51850 - RNA, 19 nt, Homo sapiens
guuuuuccacuacugcuac

SEQ ID NO: 51851 - RNA, 23 nt, Homo sapiens
uaaaaaaaaaaaaaaagccaaaa

SEQ ID NO: 51852 - RNA, 22 nt, Homo sapiens
uaaaaaaaaaacguauugcauu

SEQ ID NO: 51853 - RNA, 23 nt, Homo sapiens
uaaaaaaaaaacguauugcauuu

SEQ ID NO: 51854 - RNA, 13 nt, Homo sapiens
uaaaaaauggaac

SEQ ID NO: 51855 - RNA, 22 nt, Homo sapiens
uaaaaauauauagcgacauccu

SEQ ID NO: 51856 - RNA, 14 nt, Homo sapiens
uaaaaccacagcag

SEQ ID NO: 51857 - RNA, 15 nt, Homo sapiens
uaaaaccacagcagu

SEQ ID NO: 51858 - RNA, 19 nt, Homo sapiens
uaaaacuaggugcugcagc

SEQ ID NO: 51859 - RNA, 14 nt, Homo sapiens
uaaaacucauuuuu

SEQ ID NO: 51860 - RNA, 11 nt, Homo sapiens
uaaaacuggga

SEQ ID NO: 51861 - RNA, 13 nt, Homo sapiens
uaaaagauacagu

SEQ ID NO: 51862 - RNA, 12 nt, Homo sapiens
uaaaagcacuua

SEQ ID NO: 51863 - RNA, 23 nt, Homo sapiens
uaaaaguacauguuaaacuuacu

SEQ ID NO: 51864 - RNA, 15 nt, Homo sapiens
uaaaauaauuuuuau

SEQ ID NO: 51865 - RNA, 17 nt, Homo sapiens
uaaaauaauuuuuauau

SEQ ID NO: 51866 - RNA, 15 nt, Homo sapiens
uaaaauacacacuca

SEQ ID NO: 51867 - RNA, 17 nt, Homo sapiens
uaaaauacacacucaaa

SEQ ID NO: 51868 - RNA, 20 nt, Homo sapiens
uaaaauauuuuuaugugcaa

SEQ ID NO: 51869 - RNA, 20 nt, Homo sapiens
uaaaaucacaaacucaucca

SEQ ID NO: 51870 - RNA, 21 nt, Homo sapiens
uaaaauggagacaccaccacc

SEQ ID NO: 51871 - RNA, 20 nt, Homo sapiens
uaaaauuaucaauaucuaau

SEQ ID NO: 51872 - RNA, 8 nt, Homo sapiens
uaaaauuu

SEQ ID NO: 51873 - RNA, 9 nt, Homo sapiens
uaaaauuuu

SEQ ID NO: 51874 - RNA, 21 nt, Homo sapiens
uaaacaguagugauaguugua

SEQ ID NO: 51875 - RNA, 17 nt, Homo sapiens
uaaacauguauguaaau

SEQ ID NO: 51876 - RNA, 22 nt, Homo sapiens
uaaacauugguucuuguauuaa

SEQ ID NO: 51877 - RNA, 15 nt, Homo sapiens
uaaaccuaugaauaa

SEQ ID NO: 51878 - RNA, 20 nt, Homo sapiens
uaaacuuacuuaguguuaug

SEQ ID NO: 51879 - RNA, 15 nt, Homo sapiens
uaaagaucauguaaa

SEQ ID NO: 51880 - RNA, 15 nt, Homo sapiens
uaaagcuuugugcag

SEQ ID NO: 51881 - RNA, 17 nt, Homo sapiens
uaaagcuuugugcagau

SEQ ID NO: 51882 - RNA, 14 nt, Homo sapiens
uaaaggaagguucu

SEQ ID NO: 51883 - RNA, 17 nt, Homo sapiens
uaaaguacagacuuuuu

SEQ ID NO: 51884 - RNA, 20 nt, Homo sapiens
uaaaguguauuuuuuuacua

SEQ ID NO: 51885 - RNA, 21 nt, Homo sapiens
uaaaguguauuuuuuuacuaa

SEQ ID NO: 51886 - RNA, 14 nt, Homo sapiens
uaaaguucuaguga

SEQ ID NO: 51887 - RNA, 13 nt, Homo sapiens
uaaauaaaauuuu

SEQ ID NO: 51888 - RNA, 21 nt, Homo sapiens
uaaauaaauguaucuuauuca

SEQ ID NO: 51889 - RNA, 15 nt, Homo sapiens
uaaauaauaaagauc

SEQ ID NO: 51890 - RNA, 12 nt, Homo sapiens
uaaauagcuaag

SEQ ID NO: 51891 - RNA, 19 nt, Homo sapiens
uaaauagcuaagauauaau

SEQ ID NO: 51892 - RNA, 20 nt, Homo sapiens
uaaauggacaaaugcuuaug

SEQ ID NO: 51893 - RNA, 17 nt, Homo sapiens
uaaaugggggugcauuu

SEQ ID NO: 51894 - RNA, 19 nt, Homo sapiens
uaaaugggggugcauuuga

SEQ ID NO: 51895 - RNA, 14 nt, Homo sapiens
uaaauguaucuuau

SEQ ID NO: 51896 - RNA, 20 nt, Homo sapiens
uaaauguaucuuauucacau

SEQ ID NO: 51897 - RNA, 20 nt, Homo sapiens
uaaauucccuggccuuucau

SEQ ID NO: 51898 - RNA, 16 nt, Homo sapiens
uaaauucuuucauuuu

SEQ ID NO: 51899 - RNA, 17 nt, Homo sapiens
uaaauuugguucuaggc

SEQ ID NO: 51900 - RNA, 12 nt, Homo sapiens
uaacaaaauuug

SEQ ID NO: 51901 - RNA, 19 nt, Homo sapiens
uaacaacaacaacaaaagc

SEQ ID NO: 51902 - RNA, 16 nt, Homo sapiens
uaacaaugacuuguac

SEQ ID NO: 51903 - RNA, 23 nt, Homo sapiens
uaacaaugcuguauuuuaaaaga

SEQ ID NO: 51904 - RNA, 13 nt, Homo sapiens
uaacacagugucu

SEQ ID NO: 51905 - RNA, 14 nt, Homo sapiens
uaacagaaauguac

SEQ ID NO: 51906 - RNA, 16 nt, Homo sapiens
uaacagaaauguacag

SEQ ID NO: 51907 - RNA, 17 nt, Homo sapiens
uaacagaaauguacagc

SEQ ID NO: 51908 - RNA, 22 nt, Homo sapiens
uaaccaaagcccaaagugguau

SEQ ID NO: 51909 - RNA, 14 nt, Homo sapiens
uaaccagcagaaau

SEQ ID NO: 51910 - RNA, 18 nt, Homo sapiens
uaaccagcagaaaugccu

SEQ ID NO: 51911 - RNA, 22 nt, Homo sapiens
uaaccagcagaaaugccuuacc

SEQ ID NO: 51912 - RNA, 19 nt, Homo sapiens
uaaccucuaaauucuuuca

SEQ ID NO: 51913 - RNA, 17 nt, Homo sapiens
uaacuagaauuuauuca

SEQ ID NO: 51914 - RNA, 14 nt, Homo sapiens
uaacugcauugaga

SEQ ID NO: 51915 - RNA, 15 nt, Homo sapiens
uaacuggcaguuuuc

SEQ ID NO: 51916 - RNA, 17 nt, Homo sapiens
uaacuuaugaaccuuua

SEQ ID NO: 51917 - RNA, 17 nt, Homo sapiens
uaagaaaaaggaugcac

SEQ ID NO: 51918 - RNA, 11 nt, Homo sapiens
uaagaaaauau

SEQ ID NO: 51919 - RNA, 13 nt, Homo sapiens
uaagaaugaaaua

SEQ ID NO: 51920 - RNA, 21 nt, Homo sapiens
uaagagaacaagcaaauauaa

SEQ ID NO: 51921 - RNA, 14 nt, Homo sapiens
uaagagagucuauu

SEQ ID NO: 51922 - RNA, 21 nt, Homo sapiens
uaagcaaagacuaugaggaau

SEQ ID NO: 51923 - RNA, 13 nt, Homo sapiens
uaagcaacaucua

SEQ ID NO: 51924 - RNA, 21 nt, Homo sapiens
uaagcacuuuaacacaguguc

SEQ ID NO: 51925 - RNA, 11 nt, Homo sapiens
uaaggaaacug

SEQ ID NO: 51926 - RNA, 13 nt, Homo sapiens
uaaggaaacuggg

SEQ ID NO: 51927 - RNA, 14 nt, Homo sapiens
uaaggaaacugggu

SEQ ID NO: 51928 - RNA, 16 nt, Homo sapiens
uaagggaaacugccag

SEQ ID NO: 51929 - RNA, 21 nt, Homo sapiens
uaagguauauaaauuuuccca

SEQ ID NO: 51930 - RNA, 13 nt, Homo sapiens
uaaguaaaaccac

SEQ ID NO: 51931 - RNA, 14 nt, Homo sapiens
uaaguaaaaccaca

SEQ ID NO: 51932 - RNA, 22 nt, Homo sapiens
uaaguagggacuucugucuuca

SEQ ID NO: 51933 - RNA, 16 nt, Homo sapiens
uaaguaucagcuacaa

SEQ ID NO: 51934 - RNA, 19 nt, Homo sapiens
uaagucuguuuuaugacuu

SEQ ID NO: 51935 - RNA, 19 nt, Homo sapiens
uaagugaaauaagccagac

SEQ ID NO: 51936 - RNA, 18 nt, Homo sapiens
uaagugaagugauacuau

SEQ ID NO: 51937 - RNA, 11 nt, Homo sapiens
uaagugcagcc

SEQ ID NO: 51938 - RNA, 12 nt, Homo sapiens
uaagugcagccc

SEQ ID NO: 51939 - RNA, 19 nt, Homo sapiens
uaaguuacacauuuuucag

SEQ ID NO: 51940 - RNA, 18 nt, Homo sapiens
uaaguugcaccaacuuug

SEQ ID NO: 51941 - RNA, 20 nt, Homo sapiens
uaaguugcaccaacuuugaa

SEQ ID NO: 51942 - RNA, 19 nt, Homo sapiens
uaauaaaauacauacuaua

SEQ ID NO: 51943 - RNA, 18 nt, Homo sapiens
uaauaaaauucauuccau

SEQ ID NO: 51944 - RNA, 13 nt, Homo sapiens
uaauaauaaauuc

SEQ ID NO: 51945 - RNA, 14 nt, Homo sapiens
uaauaauguuucaa

SEQ ID NO: 51946 - RNA, 14 nt, Homo sapiens
uaauaucaucagua

SEQ ID NO: 51947 - RNA, 19 nt, Homo sapiens
uaauaugcacacauuuuuu

SEQ ID NO: 51948 - RNA, 13 nt, Homo sapiens
uaaucaacugggc

SEQ ID NO: 51949 - RNA, 15 nt, Homo sapiens
uaaucaauacuuuga

SEQ ID NO: 51950 - RNA, 12 nt, Homo sapiens
uaaucuuucaca

SEQ ID NO: 51951 - RNA, 15 nt, Homo sapiens
uaaugaaaaugaaua

SEQ ID NO: 51952 - RNA, 20 nt, Homo sapiens
uaaugaaaaugaauaucuau

SEQ ID NO: 51953 - RNA, 19 nt, Homo sapiens
uaaugaaguguuuagcaua

SEQ ID NO: 51954 - RNA, 14 nt, Homo sapiens
uaaugauaacugga

SEQ ID NO: 51955 - RNA, 22 nt, Homo sapiens
uaauggaauauguaaauagaaa

SEQ ID NO: 51956 - RNA, 21 nt, Homo sapiens
uaaugguaguuuuacaguguu

SEQ ID NO: 51957 - RNA, 18 nt, Homo sapiens
uaauguagauaaagcacu

SEQ ID NO: 51958 - RNA, 20 nt, Homo sapiens
uaauguagauaaagcacugu

SEQ ID NO: 51959 - RNA, 18 nt, Homo sapiens
uaauguagcagcucauaa

SEQ ID NO: 51960 - RNA, 14 nt, Homo sapiens
uaaugugacuugga

SEQ ID NO: 51961 - RNA, 18 nt, Homo sapiens
uaauguggaaaugauguu

SEQ ID NO: 51962 - RNA, 15 nt, Homo sapiens
uaauguuucaaacau

SEQ ID NO: 51963 - RNA, 11 nt, Homo sapiens
uaauuacuaug

SEQ ID NO: 51964 - RNA, 14 nt, Homo sapiens
uaauuacuauguca

SEQ ID NO: 51965 - RNA, 15 nt, Homo sapiens
uaauucaaacuaaua

SEQ ID NO: 51966 - RNA, 19 nt, Homo sapiens
uaauucuuagcucauucuc

SEQ ID NO: 51967 - RNA, 12 nt, Homo sapiens
uaauucuuuauc

SEQ ID NO: 51968 - RNA, 16 nt, Homo sapiens
uaauucuuuaucacau

SEQ ID NO: 51969 - RNA, 11 nt, Homo sapiens
uaauuggaaag

SEQ ID NO: 51970 - RNA, 12 nt, Homo sapiens
uaauuggaaagg

SEQ ID NO: 51971 - RNA, 13 nt, Homo sapiens
uaauuucaugaaa

SEQ ID NO: 51972 - RNA, 14 nt, Homo sapiens
uaauuugguuuuca

SEQ ID NO: 51973 - RNA, 21 nt, Homo sapiens
uaauuuguaguguuggagaag

SEQ ID NO: 51974 - RNA, 18 nt, Homo sapiens
uaauuuuagacauucuuu

SEQ ID NO: 51975 - RNA, 15 nt, Homo sapiens
uaauuuuauuauagu

SEQ ID NO: 51976 - RNA, 23 nt, Homo sapiens
uaauuuuuuugugggaaauccac

SEQ ID NO: 51977 - RNA, 15 nt, Homo sapiens
uacaaaaacacagca

SEQ ID NO: 51978 - RNA, 17 nt, Homo sapiens
uacaaaaacacagcaag

SEQ ID NO: 51979 - RNA, 19 nt, Homo sapiens
uacaaaaauuagccgggca

SEQ ID NO: 51980 - RNA, 20 nt, Homo sapiens
uacaaaaauuagccgggcau

SEQ ID NO: 51981 - RNA, 15 nt, Homo sapiens
uacaaaagcauguga

SEQ ID NO: 51982 - RNA, 18 nt, Homo sapiens
uacaaaauauagcuuuca

SEQ ID NO: 51983 - RNA, 19 nt, Homo sapiens
uacaaggcuuuaucucagg

SEQ ID NO: 51984 - RNA, 22 nt, Homo sapiens
uacaauuauuuuuacaguucuc

SEQ ID NO: 51985 - RNA, 19 nt, Homo sapiens
uacacauuuuauuuuauua

SEQ ID NO: 51986 - RNA, 16 nt, Homo sapiens
uacaccagagauaaua

SEQ ID NO: 51987 - RNA, 20 nt, Homo sapiens
uacacuguuaucuucacuuu

SEQ ID NO: 51988 - RNA, 18 nt, Homo sapiens
uacagagaaaagacauaa

SEQ ID NO: 51989 - RNA, 12 nt, Homo sapiens
uacagccaggcg

SEQ ID NO: 51990 - RNA, 20 nt, Homo sapiens
uacaggaacagaagaggaaa

SEQ ID NO: 51991 - RNA, 23 nt, Homo sapiens
uacaggcgugagccaccaaaccc

SEQ ID NO: 51992 - RNA, 16 nt, Homo sapiens
uacagucuuguauuaa

SEQ ID NO: 51993 - RNA, 16 nt, Homo sapiens
uacaguucucccaagg

SEQ ID NO: 51994 - RNA, 20 nt, Homo sapiens
uacaguuuuuauugcuuguu

SEQ ID NO: 51995 - RNA, 17 nt, Homo sapiens
uacauaaugcgugcaua

SEQ ID NO: 51996 - RNA, 16 nt, Homo sapiens
uacauacuauggaauu

SEQ ID NO: 51997 - RNA, 11 nt, Homo sapiens
uacauacugcu

SEQ ID NO: 51998 - RNA, 12 nt, Homo sapiens
uacauacugcug

SEQ ID NO: 51999 - RNA, 13 nt, Homo sapiens
uacauacugcugu

SEQ ID NO: 52000 - RNA, 19 nt, Homo sapiens
uacaucaaugauaaugcua

SEQ ID NO: 52001 - RNA, 12 nt, Homo sapiens
uacaucuuucac

SEQ ID NO: 52002 - RNA, 14 nt, Homo sapiens
uacaucuuucacau

SEQ ID NO: 52003 - RNA, 16 nt, Homo sapiens
uacauggcuggagcua

SEQ ID NO: 52004 - RNA, 19 nt, Homo sapiens
uacauguauuuguuugcau

SEQ ID NO: 52005 - RNA, 19 nt, Homo sapiens
uacauuauuggacuuccau

SEQ ID NO: 52006 - RNA, 23 nt, Homo sapiens
uacauuguuugucugucuucaua

SEQ ID NO: 52007 - RNA, 16 nt, Homo sapiens
uacauuuccaaauuca

SEQ ID NO: 52008 - RNA, 18 nt, Homo sapiens
uacauuuccaaauucaca

SEQ ID NO: 52009 - RNA, 19 nt, Homo sapiens
uacauuuccaaauucacaa

SEQ ID NO: 52010 - RNA, 13 nt, Homo sapiens
uaccaaaaaucuc

SEQ ID NO: 52011 - RNA, 22 nt, Homo sapiens
uaccacagacauacuaaccagc

SEQ ID NO: 52012 - RNA, 18 nt, Homo sapiens
uaccacaggaaccacaag

SEQ ID NO: 52013 - RNA, 13 nt, Homo sapiens
uacccaaauggaa

SEQ ID NO: 52014 - RNA, 14 nt, Homo sapiens
uacccaaauggaaa

SEQ ID NO: 52015 - RNA, 11 nt, Homo sapiens
uacccucuggg

SEQ ID NO: 52016 - RNA, 15 nt, Homo sapiens
uaccuaucaucuuaa

SEQ ID NO: 52017 - RNA, 18 nt, Homo sapiens
uaccucugccucagaaaa

SEQ ID NO: 52018 - RNA, 22 nt, Homo sapiens
uaccucugcuauuugcuguuau

SEQ ID NO: 52019 - RNA, 21 nt, Homo sapiens
uaccugugaaauaguucaaag

SEQ ID NO: 52020 - RNA, 17 nt, Homo sapiens
uaccuguucgcgcgccu

SEQ ID NO: 52021 - RNA, 18 nt, Homo sapiens
uaccuguucgcgcgccuc

SEQ ID NO: 52022 - RNA, 19 nt, Homo sapiens
uaccuguucgcgcgccucc

SEQ ID NO: 52023 - RNA, 21 nt, Homo sapiens
uaccuguucgcgcgccuccgc

SEQ ID NO: 52024 - RNA, 15 nt, Homo sapiens
uaccuuuuuccuucc

SEQ ID NO: 52025 - RNA, 17 nt, Homo sapiens
uaccuuuuuuauacaua

SEQ ID NO: 52026 - RNA, 16 nt, Homo sapiens
uacgcgagcgcgcgcg

SEQ ID NO: 52027 - RNA, 18 nt, Homo sapiens
uacgcgagcgcgcgcgcc

SEQ ID NO: 52028 - RNA, 19 nt, Homo sapiens
uacgcgagcgcgcgcgccc

SEQ ID NO: 52029 - RNA, 12 nt, Homo sapiens
uacgcgcgcucc

SEQ ID NO: 52030 - RNA, 16 nt, Homo sapiens
uacgcgcgcuccgcgc

SEQ ID NO: 52031 - RNA, 21 nt, Homo sapiens
uacgcgcgcuccgcgcagcuc

SEQ ID NO: 52032 - RNA, 11 nt, Homo sapiens
uacgugcaaua

SEQ ID NO: 52033 - RNA, 14 nt, Homo sapiens
uacguugugcauuu

SEQ ID NO: 52034 - RNA, 14 nt, Homo sapiens
uacuaauagacaau

SEQ ID NO: 52035 - RNA, 20 nt, Homo sapiens
uacuaauagacaauuuauua

SEQ ID NO: 52036 - RNA, 18 nt, Homo sapiens
uacuauagauucuuuauu

SEQ ID NO: 52037 - RNA, 20 nt, Homo sapiens
uacuauuuaagagaacaagc

SEQ ID NO: 52038 - RNA, 17 nt, Homo sapiens
uacucuguuccuucaca

SEQ ID NO: 52039 - RNA, 18 nt, Homo sapiens
uacucuguuccuucacau

SEQ ID NO: 52040 - RNA, 13 nt, Homo sapiens
uacucuuauaucu

SEQ ID NO: 52041 - RNA, 17 nt, Homo sapiens
uacugcuaccacaacua

SEQ ID NO: 52042 - RNA, 18 nt, Homo sapiens
uacuguaauuugugauac

SEQ ID NO: 52043 - RNA, 17 nt, Homo sapiens
uacuguccccaucauca

SEQ ID NO: 52044 - RNA, 23 nt, Homo sapiens
uacuucccgcuguuccucgccac

SEQ ID NO: 52045 - RNA, 13 nt, Homo sapiens
uacuucuucucau

SEQ ID NO: 52046 - RNA, 15 nt, Homo sapiens
uacuucuucucauac

SEQ ID NO: 52047 - RNA, 17 nt, Homo sapiens
uacuucuucucauacua

SEQ ID NO: 52048 - RNA, 21 nt, Homo sapiens
uacuuugaacacaaagccugu

SEQ ID NO: 52049 - RNA, 17 nt, Homo sapiens
uacuuuuaaacuuugau

SEQ ID NO: 52050 - RNA, 21 nt, Homo sapiens
uagaaaaauuagaugacugaa

SEQ ID NO: 52051 - RNA, 19 nt, Homo sapiens
uagaaagcugaguguuuca

SEQ ID NO: 52052 - RNA, 13 nt, Homo sapiens
uagaagauucuau

SEQ ID NO: 52053 - RNA, 15 nt, Homo sapiens
uagaagcaucacagg

SEQ ID NO: 52054 - RNA, 19 nt, Homo sapiens
uagaagucacauuccugaa

SEQ ID NO: 52055 - RNA, 21 nt, Homo sapiens
uagaauauauuuccuuauuca

SEQ ID NO: 52056 - RNA, 17 nt, Homo sapiens
uagaauauuuauuaccu

SEQ ID NO: 52057 - RNA, 23 nt, Homo sapiens
uagaauauuuauuaccucugaua

SEQ ID NO: 52058 - RNA, 16 nt, Homo sapiens
uagaauuaacacauga

SEQ ID NO: 52059 - RNA, 23 nt, Homo sapiens
uagaauuaacacaugauccugca

SEQ ID NO: 52060 - RNA, 15 nt, Homo sapiens
uagaauuaauggaau

SEQ ID NO: 52061 - RNA, 21 nt, Homo sapiens
uagaauucacuccacuuggac

SEQ ID NO: 52062 - RNA, 19 nt, Homo sapiens
uagacaauuuauuauggca

SEQ ID NO: 52063 - RNA, 15 nt, Homo sapiens
uagacauucuuuauc

SEQ ID NO: 52064 - RNA, 14 nt, Homo sapiens
uagacccucaugcu

SEQ ID NO: 52065 - RNA, 17 nt, Homo sapiens
uagacccucaugcugcc

SEQ ID NO: 52066 - RNA, 19 nt, Homo sapiens
uagacccucaugcugccaa

SEQ ID NO: 52067 - RNA, 17 nt, Homo sapiens
uagagaaauuugccaau

SEQ ID NO: 52068 - RNA, 19 nt, Homo sapiens
uagagaaauuugccaauuu

SEQ ID NO: 52069 - RNA, 16 nt, Homo sapiens
uagagaauuuccuuac

SEQ ID NO: 52070 - RNA, 16 nt, Homo sapiens
uagagugggacaguuc

SEQ ID NO: 52071 - RNA, 20 nt, Homo sapiens
uagagugggacaguuccuga

SEQ ID NO: 52072 - RNA, 14 nt, Homo sapiens
uagaguugauacua

SEQ ID NO: 52073 - RNA, 15 nt, Homo sapiens
uagauaaacucagaa

SEQ ID NO: 52074 - RNA, 14 nt, Homo sapiens
uagauaaagcacug

SEQ ID NO: 52075 - RNA, 22 nt, Homo sapiens
uagauaaagcacuguuuggaua

SEQ ID NO: 52076 - RNA, 20 nt, Homo sapiens
uagauaaucucuccauuccc

SEQ ID NO: 52077 - RNA, 12 nt, Homo sapiens
uagauacuguau

SEQ ID NO: 52078 - RNA, 14 nt, Homo sapiens
uagaugaaugucag

SEQ ID NO: 52079 - RNA, 17 nt, Homo sapiens
uagauguauagguugau

SEQ ID NO: 52080 - RNA, 19 nt, Homo sapiens
uagauucccugagcaggau

SEQ ID NO: 52081 - RNA, 20 nt, Homo sapiens
uagcaaaucuacugucaauu

SEQ ID NO: 52082 - RNA, 18 nt, Homo sapiens
uagcaaauuccaauacau

SEQ ID NO: 52083 - RNA, 12 nt, Homo sapiens
uagcaucucagg

SEQ ID NO: 52084 - RNA, 16 nt, Homo sapiens
uagccagguaccuucu

SEQ ID NO: 52085 - RNA, 18 nt, Homo sapiens
uagccagguaccuucuca

SEQ ID NO: 52086 - RNA, 13 nt, Homo sapiens
uagcuuuacuguu

SEQ ID NO: 52087 - RNA, 13 nt, Homo sapiens
uaggaaauauuua

SEQ ID NO: 52088 - RNA, 14 nt, Homo sapiens
uaggaaauauuuau

SEQ ID NO: 52089 - RNA, 18 nt, Homo sapiens
uaggaaauauuuauuuua

SEQ ID NO: 52090 - RNA, 11 nt, Homo sapiens
uaggaacuuaa

SEQ ID NO: 52091 - RNA, 12 nt, Homo sapiens
uaggaacuuaaa

SEQ ID NO: 52092 - RNA, 16 nt, Homo sapiens
uaggaagagaaaccag

SEQ ID NO: 52093 - RNA, 14 nt, Homo sapiens
uaggcuauucacaa

SEQ ID NO: 52094 - RNA, 12 nt, Homo sapiens
uagggaccugcu

SEQ ID NO: 52095 - RNA, 13 nt, Homo sapiens
uagggaccugcug

SEQ ID NO: 52096 - RNA, 14 nt, Homo sapiens
uagggaccugcugu

SEQ ID NO: 52097 - RNA, 23 nt, Homo sapiens
uaggugcuacaaaaacacagcaa

SEQ ID NO: 52098 - RNA, 23 nt, Homo sapiens
uagguuuggacaaaauggaauac

SEQ ID NO: 52099 - RNA, 23 nt, Homo sapiens
uaguaaugugacuuggauucaau

SEQ ID NO: 52100 - RNA, 17 nt, Homo sapiens
uaguaugaggcauuugu

SEQ ID NO: 52101 - RNA, 16 nt, Homo sapiens
uaguaugugcauuuaa

SEQ ID NO: 52102 - RNA, 23 nt, Homo sapiens
uagucacuaguuguaauuuuuuu

SEQ ID NO: 52103 - RNA, 13 nt, Homo sapiens
uagucucuaucau

SEQ ID NO: 52104 - RNA, 17 nt, Homo sapiens
uagucucuaucauuaaa

SEQ ID NO: 52105 - RNA, 18 nt, Homo sapiens
uagucucuaucauuaaag

SEQ ID NO: 52106 - RNA, 19 nt, Homo sapiens
uagugaaguaugcacuaau

SEQ ID NO: 52107 - RNA, 21 nt, Homo sapiens
uaguguuggaaaaugugcaau

SEQ ID NO: 52108 - RNA, 22 nt, Homo sapiens
uaguguuggagaagaacugaaa

SEQ ID NO: 52109 - RNA, 18 nt, Homo sapiens
uaguuacuaaacauguau

SEQ ID NO: 52110 - RNA, 13 nt, Homo sapiens
uaguuagcuuucu

SEQ ID NO: 52111 - RNA, 19 nt, Homo sapiens
uaguucaaucuggauucau

SEQ ID NO: 52112 - RNA, 12 nt, Homo sapiens
uaguugcuguau

SEQ ID NO: 52113 - RNA, 22 nt, Homo sapiens
uaguuguaauuuuuuuguggga

SEQ ID NO: 52114 - RNA, 19 nt, Homo sapiens
uaguuuuacaguguuucug

SEQ ID NO: 52115 - RNA, 13 nt, Homo sapiens
uauaaaauaauuu

SEQ ID NO: 52116 - RNA, 21 nt, Homo sapiens
uauaaauuuaucauuuaguua

SEQ ID NO: 52117 - RNA, 23 nt, Homo sapiens
uauaaauuuucccaaaacugaua

SEQ ID NO: 52118 - RNA, 17 nt, Homo sapiens
uauaauuuaaacgugau

SEQ ID NO: 52119 - RNA, 13 nt, Homo sapiens
uauaauuuuguga

SEQ ID NO: 52120 - RNA, 23 nt, Homo sapiens
uauaauuuugugaagcaaaauuu

SEQ ID NO: 52121 - RNA, 17 nt, Homo sapiens
uauacauaaacaagacc

SEQ ID NO: 52122 - RNA, 14 nt, Homo sapiens
uauagacucuagga

SEQ ID NO: 52123 - RNA, 21 nt, Homo sapiens
uauagauucuuuauuagugaa

SEQ ID NO: 52124 - RNA, 14 nt, Homo sapiens
uauagcuuucauaa

SEQ ID NO: 52125 - RNA, 21 nt, Homo sapiens
uauagugucuugggaauuuuc

SEQ ID NO: 52126 - RNA, 20 nt, Homo sapiens
uauaguuacccaaauuaaga

SEQ ID NO: 52127 - RNA, 17 nt, Homo sapiens
uauauaugugaugaucu

SEQ ID NO: 52128 - RNA, 19 nt, Homo sapiens
uauaucaguccucuuucaa

SEQ ID NO: 52129 - RNA, 14 nt, Homo sapiens
uauauccugugacu

SEQ ID NO: 52130 - RNA, 14 nt, Homo sapiens
uauaucuauauuuu

SEQ ID NO: 52131 - RNA, 18 nt, Homo sapiens
uauaugugaugaucuacc

SEQ ID NO: 52132 - RNA, 15 nt, Homo sapiens
uaucaauaucuaaua

SEQ ID NO: 52133 - RNA, 16 nt, Homo sapiens
uaucaauccaagaacu

SEQ ID NO: 52134 - RNA, 13 nt, Homo sapiens
uaucaguccaaag

SEQ ID NO: 52135 - RNA, 18 nt, Homo sapiens
uaucccaaccucucccaa

SEQ ID NO: 52136 - RNA, 23 nt, Homo sapiens
uauccuaauaaaaaggugaccau

SEQ ID NO: 52137 - RNA, 18 nt, Homo sapiens
uauccuccaugaauauca

SEQ ID NO: 52138 - RNA, 18 nt, Homo sapiens
uaucgccaucacagcuga

SEQ ID NO: 52139 - RNA, 19 nt, Homo sapiens
uaucgccaucacagcugaa

SEQ ID NO: 52140 - RNA, 19 nt, Homo sapiens
uaucuaauauauaugaaua

SEQ ID NO: 52141 - RNA, 16 nt, Homo sapiens
uaucuauguagaauau

SEQ ID NO: 52142 - RNA, 16 nt, Homo sapiens
uaucugcuaugcuauu

SEQ ID NO: 52143 - RNA, 15 nt, Homo sapiens
uaucuucacuuuuau

SEQ ID NO: 52144 - RNA, 20 nt, Homo sapiens
uaucuuguuuuuccacuacu

SEQ ID NO: 52145 - RNA, 15 nt, Homo sapiens
uaugaaaaugucauu

SEQ ID NO: 52146 - RNA, 22 nt, Homo sapiens
uaugaaacuuuuggaagguauu

SEQ ID NO: 52147 - RNA, 21 nt, Homo sapiens
uaugagaaucagaucauuuca

SEQ ID NO: 52148 - RNA, 22 nt, Homo sapiens
uaugaggcauuuguuugaacug

SEQ ID NO: 52149 - RNA, 17 nt, Homo sapiens
uaugauuccaccuacau

SEQ ID NO: 52150 - RNA, 23 nt, Homo sapiens
uaugcaaccuuuggaugcacuuu

SEQ ID NO: 52151 - RNA, 18 nt, Homo sapiens
uaugcacacauuuuuuaa

SEQ ID NO: 52152 - RNA, 12 nt, Homo sapiens
uaugcacuaauc

SEQ ID NO: 52153 - RNA, 14 nt, Homo sapiens
uaugcauacaguaa

SEQ ID NO: 52154 - RNA, 11 nt, Homo sapiens
uaugcauuuga

SEQ ID NO: 52155 - RNA, 15 nt, Homo sapiens
uaugccuuuucccaa

SEQ ID NO: 52156 - RNA, 15 nt, Homo sapiens
uaugcuaagugaaau

SEQ ID NO: 52157 - RNA, 18 nt, Homo sapiens
uaugcuauugaaguuuug

SEQ ID NO: 52158 - RNA, 21 nt, Homo sapiens
uaugcuauuuauuaaguauuu

SEQ ID NO: 52159 - RNA, 20 nt, Homo sapiens
uauggcacuaguauuucuau

SEQ ID NO: 52160 - RNA, 16 nt, Homo sapiens
uauggcuuaaugacac

SEQ ID NO: 52161 - RNA, 17 nt, Homo sapiens
uauggcuuuugugcauu

SEQ ID NO: 52162 - RNA, 20 nt, Homo sapiens
uauggcuuuugugcauuauc

SEQ ID NO: 52163 - RNA, 21 nt, Homo sapiens
uauguaaauagcuaagauaua

SEQ ID NO: 52164 - RNA, 12 nt, Homo sapiens
uauguaauuaua

SEQ ID NO: 52165 - RNA, 24 nt, Homo sapiens
uaugucauuugcuggagcucugcc

SEQ ID NO: 52166 - RNA, 14 nt, Homo sapiens
uaugugauguggca

SEQ ID NO: 52167 - RNA, 9 nt, Homo sapiens
uaugugcaa

SEQ ID NO: 52168 - RNA, 10 nt, Homo sapiens
uaugugcaau

SEQ ID NO: 52169 - RNA, 11 nt, Homo sapiens
uaugugcaaua

SEQ ID NO: 52170 - RNA, 12 nt, Homo sapiens
uaugugcacauc

SEQ ID NO: 52171 - RNA, 15 nt, Homo sapiens
uaugugcacaucugu

SEQ ID NO: 52172 - RNA, 15 nt, Homo sapiens
uaugugcauauuuua

SEQ ID NO: 52173 - RNA, 15 nt, Homo sapiens
uauguucuaagaagu

SEQ ID NO: 52174 - RNA, 15 nt, Homo sapiens
uauuaaagaucugca

SEQ ID NO: 52175 - RNA, 17 nt, Homo sapiens
uauuaauauuuaacauu

SEQ ID NO: 52176 - RNA, 12 nt, Homo sapiens
uauuacaucuuu

SEQ ID NO: 52177 - RNA, 15 nt, Homo sapiens
uauuacgugcaauac

SEQ ID NO: 52178 - RNA, 16 nt, Homo sapiens
uauuacgugcaauacu

SEQ ID NO: 52179 - RNA, 21 nt, Homo sapiens
uauuauuuuagagcaucucau

SEQ ID NO: 52180 - RNA, 15 nt, Homo sapiens
uauucauuaguuuug

SEQ ID NO: 52181 - RNA, 16 nt, Homo sapiens
uauucccuuuugcugc

SEQ ID NO: 52182 - RNA, 22 nt, Homo sapiens
uauugaaaugauuucacagugu

SEQ ID NO: 52183 - RNA, 17 nt, Homo sapiens
uauugaagcauuuuaua

SEQ ID NO: 52184 - RNA, 16 nt, Homo sapiens
uauugagcaccugcag

SEQ ID NO: 52185 - RNA, 16 nt, Homo sapiens
uauugaggcuuuaaaa

SEQ ID NO: 52186 - RNA, 20 nt, Homo sapiens
uauugauguuuucacaaaga

SEQ ID NO: 52187 - RNA, 22 nt, Homo sapiens
uauugauuuccguuaaaauacc

SEQ ID NO: 52188 - RNA, 17 nt, Homo sapiens
uauugcugaaugacuac

SEQ ID NO: 52189 - RNA, 13 nt, Homo sapiens
uauuggacuucca

SEQ ID NO: 52190 - RNA, 20 nt, Homo sapiens
uauuguagcauccuggaaua

SEQ ID NO: 52191 - RNA, 18 nt, Homo sapiens
uauugucuagugaaacuc

SEQ ID NO: 52192 - RNA, 18 nt, Homo sapiens
uauuguugacaacuguga

SEQ ID NO: 52193 - RNA, 16 nt, Homo sapiens
uauuguuugcuaagca

SEQ ID NO: 52194 - RNA, 18 nt, Homo sapiens
uauuuaaagacaaagaca

SEQ ID NO: 52195 - RNA, 19 nt, Homo sapiens
uauuuaaccucuaaauucu

SEQ ID NO: 52196 - RNA, 22 nt, Homo sapiens
uauuuacggaacucaaauacgu

SEQ ID NO: 52197 - RNA, 21 nt, Homo sapiens
uauuuacugagcuucucugug

SEQ ID NO: 52198 - RNA, 15 nt, Homo sapiens
uauuuauaaucacuu

SEQ ID NO: 52199 - RNA, 22 nt, Homo sapiens
uauuuauugaaaugauuucaca

SEQ ID NO: 52200 - RNA, 13 nt, Homo sapiens
uauuuauuuacug

SEQ ID NO: 52201 - RNA, 13 nt, Homo sapiens
uauuuauuuguuu

SEQ ID NO: 52202 - RNA, 13 nt, Homo sapiens
uauuucacuuuag

SEQ ID NO: 52203 - RNA, 19 nt, Homo sapiens
uauuucagauaaucacaau

SEQ ID NO: 52204 - RNA, 12 nt, Homo sapiens
uauuucauuucu

SEQ ID NO: 52205 - RNA, 13 nt, Homo sapiens
uauuucauuucuu

SEQ ID NO: 52206 - RNA, 22 nt, Homo sapiens
uauuuccauauuaaaaucacaa

SEQ ID NO: 52207 - RNA, 10 nt, Homo sapiens
uauuugagac

SEQ ID NO: 52208 - RNA, 20 nt, Homo sapiens
uauuuguacaccaauauuca

SEQ ID NO: 52209 - RNA, 18 nt, Homo sapiens
uauuuuaauaauguuuca

SEQ ID NO: 52210 - RNA, 19 nt, Homo sapiens
uauuuuaauaauguuucaa

SEQ ID NO: 52211 - RNA, 13 nt, Homo sapiens
uauuuuaaucacc

SEQ ID NO: 52212 - RNA, 17 nt, Homo sapiens
uauuuuagagcaucuca

SEQ ID NO: 52213 - RNA, 18 nt, Homo sapiens
uauuuuagagcaucucau

SEQ ID NO: 52214 - RNA, 13 nt, Homo sapiens
uauuuuaggucaa

SEQ ID NO: 52215 - RNA, 14 nt, Homo sapiens
uauuuucaugcugu

SEQ ID NO: 52216 - RNA, 14 nt, Homo sapiens
uauuuuuaugugca

SEQ ID NO: 52217 - RNA, 15 nt, Homo sapiens
uauuuuuaugugcaa

SEQ ID NO: 52218 - RNA, 17 nt, Homo sapiens
uauuuuuuucugaaauu

SEQ ID NO: 52219 - RNA, 12 nt, Homo sapiens
ucaaaacugcac

SEQ ID NO: 52220 - RNA, 17 nt, Homo sapiens
ucaaaacugcacuguca

SEQ ID NO: 52221 - RNA, 22 nt, Homo sapiens
ucaaaagguauuuauugagcac

SEQ ID NO: 52222 - RNA, 22 nt, Homo sapiens
ucaaaauaccaugccauuuaaa

SEQ ID NO: 52223 - RNA, 14 nt, Homo sapiens
ucaaacauauauaa

SEQ ID NO: 52224 - RNA, 21 nt, Homo sapiens
ucaaacccaaguuaguucaau

SEQ ID NO: 52225 - RNA, 22 nt, Homo sapiens
ucaaacccaaguuaguucaauc

SEQ ID NO: 52226 - RNA, 16 nt, Homo sapiens
ucaaagauagggaggg

SEQ ID NO: 52227 - RNA, 20 nt, Homo sapiens
ucaaagauauuuugcuuugu

SEQ ID NO: 52228 - RNA, 18 nt, Homo sapiens
ucaaaguuaagaaucuuu

SEQ ID NO: 52229 - RNA, 20 nt, Homo sapiens
ucaaaguuaagaaucuuuau

SEQ ID NO: 52230 - RNA, 14 nt, Homo sapiens
ucaaauaugcaaag

SEQ ID NO: 52231 - RNA, 21 nt, Homo sapiens
ucaaauaugcaaagcacugac

SEQ ID NO: 52232 - RNA, 18 nt, Homo sapiens
ucaaauguucuccaguca

SEQ ID NO: 52233 - RNA, 13 nt, Homo sapiens
ucaaauuccagaa

SEQ ID NO: 52234 - RNA, 15 nt, Homo sapiens
ucaaccaccuuucag

SEQ ID NO: 52235 - RNA, 14 nt, Homo sapiens
ucaacucauauuuu

SEQ ID NO: 52236 - RNA, 19 nt, Homo sapiens
ucaagaugaugaugaucuu

SEQ ID NO: 52237 - RNA, 14 nt, Homo sapiens
ucaagccugccuca

SEQ ID NO: 52238 - RNA, 11 nt, Homo sapiens
ucaauaaaacu

SEQ ID NO: 52239 - RNA, 12 nt, Homo sapiens
ucaauaaaacuu

SEQ ID NO: 52240 - RNA, 16 nt, Homo sapiens
ucaauacuuugaacac

SEQ ID NO: 52241 - RNA, 10 nt, Homo sapiens
ucaauauuua

SEQ ID NO: 52242 - RNA, 22 nt, Homo sapiens
ucaauauuuauuauuuucaccu

SEQ ID NO: 52243 - RNA, 23 nt, Homo sapiens
ucaauauuuauuauuuucaccug

SEQ ID NO: 52244 - RNA, 14 nt, Homo sapiens
ucaauauuucagau

SEQ ID NO: 52245 - RNA, 18 nt, Homo sapiens
ucaaucagccuaguugau

SEQ ID NO: 52246 - RNA, 16 nt, Homo sapiens
ucaaucaguauucaua

SEQ ID NO: 52247 - RNA, 17 nt, Homo sapiens
ucaauccaagaacuuau

SEQ ID NO: 52248 - RNA, 16 nt, Homo sapiens
ucaaugaaugaaugaa

SEQ ID NO: 52249 - RNA, 11 nt, Homo sapiens
ucaaugcagcc

SEQ ID NO: 52250 - RNA, 17 nt, Homo sapiens
ucaaugccccugaauuu

SEQ ID NO: 52251 - RNA, 19 nt, Homo sapiens
ucaauguuuagcagauuua

SEQ ID NO: 52252 - RNA, 21 nt, Homo sapiens
ucaauucuauuacgugcaaua

SEQ ID NO: 52253 - RNA, 20 nt, Homo sapiens
ucaauuuuaaggcauauuua

SEQ ID NO: 52254 - RNA, 19 nt, Homo sapiens
ucacaaaaguauauucaaa

SEQ ID NO: 52255 - RNA, 15 nt, Homo sapiens
ucacaaacucaucca

SEQ ID NO: 52256 - RNA, 20 nt, Homo sapiens
ucacaaacucauccauuaau

SEQ ID NO: 52257 - RNA, 19 nt, Homo sapiens
ucacaaaucuuaacuugaa

SEQ ID NO: 52258 - RNA, 23 nt, Homo sapiens
ucacaaaucuuaacuugaaggag

SEQ ID NO: 52259 - RNA, 23 nt, Homo sapiens
ucacaacagauuauuaccuuaca

SEQ ID NO: 52260 - RNA, 19 nt, Homo sapiens
ucacaaccacucauucaaa

SEQ ID NO: 52261 - RNA, 14 nt, Homo sapiens
ucacaagcacuuuc

SEQ ID NO: 52262 - RNA, 20 nt, Homo sapiens
ucacagauaccucucuugua

SEQ ID NO: 52263 - RNA, 22 nt, Homo sapiens
ucacaggaaguagaggaggcca

SEQ ID NO: 52264 - RNA, 15 nt, Homo sapiens
ucacagguugaccaa

SEQ ID NO: 52265 - RNA, 16 nt, Homo sapiens
ucacagguugaccaau

SEQ ID NO: 52266 - RNA, 20 nt, Homo sapiens
ucacaguuuugguugcuuua

SEQ ID NO: 52267 - RNA, 21 nt, Homo sapiens
ucacaguuuugguugcuuuaa

SEQ ID NO: 52268 - RNA, 23 nt, Homo sapiens
ucacauuccaagccucaugucca

SEQ ID NO: 52269 - RNA, 23 nt, Homo sapiens
ucacauuggcuauuuaaagacaa

SEQ ID NO: 52270 - RNA, 11 nt, Homo sapiens
ucacauuugcg

SEQ ID NO: 52271 - RNA, 23 nt, Homo sapiens
ucaccugugagaccaaauugagc

SEQ ID NO: 52272 - RNA, 10 nt, Homo sapiens
ucaccuguuu

SEQ ID NO: 52273 - RNA, 14 nt, Homo sapiens
ucaccuuccagugu

SEQ ID NO: 52274 - RNA, 14 nt, Homo sapiens
ucacuggcuguuaa

SEQ ID NO: 52275 - RNA, 15 nt, Homo sapiens
ucacuggcuguuaau

SEQ ID NO: 52276 - RNA, 20 nt, Homo sapiens
ucacuggcuguuaaucuuuc

SEQ ID NO: 52277 - RNA, 11 nt, Homo sapiens
ucacuugauga

SEQ ID NO: 52278 - RNA, 13 nt, Homo sapiens
ucacuugaugaua

SEQ ID NO: 52279 - RNA, 12 nt, Homo sapiens
ucacuuguuuua

SEQ ID NO: 52280 - RNA, 13 nt, Homo sapiens
ucacuuguuuuau

SEQ ID NO: 52281 - RNA, 15 nt, Homo sapiens
ucacuuuuauaagaa

SEQ ID NO: 52282 - RNA, 23 nt, Homo sapiens
ucacuuuuuuucuuuucucugcc

SEQ ID NO: 52283 - RNA, 16 nt, Homo sapiens
ucagaaaacaaggaug

SEQ ID NO: 52284 - RNA, 17 nt, Homo sapiens
ucagaaauguguuauca

SEQ ID NO: 52285 - RNA, 23 nt, Homo sapiens
ucagaaauuuaauucauguuucu

SEQ ID NO: 52286 - RNA, 16 nt, Homo sapiens
ucagaagaaauucugc

SEQ ID NO: 52287 - RNA, 23 nt, Homo sapiens
ucagauauaaaagacugaccaau

SEQ ID NO: 52288 - RNA, 22 nt, Homo sapiens
ucagcaccuacaguguacaguc

SEQ ID NO: 52289 - RNA, 17 nt, Homo sapiens
ucagcagagaaguuuuc

SEQ ID NO: 52290 - RNA, 13 nt, Homo sapiens
ucagccacuguga

SEQ ID NO: 52291 - RNA, 13 nt, Homo sapiens
ucagccagcccuc

SEQ ID NO: 52292 - RNA, 13 nt, Homo sapiens
ucagccccgggag

SEQ ID NO: 52293 - RNA, 19 nt, Homo sapiens
ucagccccgggaguggcgc

SEQ ID NO: 52294 - RNA, 21 nt, Homo sapiens
ucagccccgggaguggcgcgc

SEQ ID NO: 52295 - RNA, 23 nt, Homo sapiens
ucagccccgggaguggcgcgcgc

SEQ ID NO: 52296 - RNA, 21 nt, Homo sapiens
ucagccugaaagaggaaugaa

SEQ ID NO: 52297 - RNA, 22 nt, Homo sapiens
ucagccugaaagaggaaugaag

SEQ ID NO: 52298 - RNA, 15 nt, Homo sapiens
ucagcuacaauugua

SEQ ID NO: 52299 - RNA, 21 nt, Homo sapiens
ucagcucagcuaaugaagugu

SEQ ID NO: 52300 - RNA, 19 nt, Homo sapiens
ucagcucucaguugcagcc

SEQ ID NO: 52301 - RNA, 24 nt, Homo sapiens
ucagcucucaguugcagcccugcu

SEQ ID NO: 52302 - RNA, 22 nt, Homo sapiens
ucaggaaaucaaauaugcaaag

SEQ ID NO: 52303 - RNA, 17 nt, Homo sapiens
ucaggaguuccuaacca

SEQ ID NO: 52304 - RNA, 18 nt, Homo sapiens
ucaggaguuccuaaccag

SEQ ID NO: 52305 - RNA, 15 nt, Homo sapiens
ucaggaugcccacgg

SEQ ID NO: 52306 - RNA, 16 nt, Homo sapiens
ucaggaugcccacggc

SEQ ID NO: 52307 - RNA, 22 nt, Homo sapiens
ucaggcuagauguauguacuuc

SEQ ID NO: 52308 - RNA, 15 nt, Homo sapiens
ucaggcuggcaccgc

SEQ ID NO: 52309 - RNA, 21 nt, Homo sapiens
ucaggcuggcaccgcuguacg

SEQ ID NO: 52310 - RNA, 11 nt, Homo sapiens
ucaggcuggcc

SEQ ID NO: 52311 - RNA, 15 nt, Homo sapiens
ucagggagcauuuau

SEQ ID NO: 52312 - RNA, 16 nt, Homo sapiens
ucaggugacccugaug

SEQ ID NO: 52313 - RNA, 20 nt, Homo sapiens
ucaggugacccugaugaaaa

SEQ ID NO: 52314 - RNA, 18 nt, Homo sapiens
ucaguccaugaagaugua

SEQ ID NO: 52315 - RNA, 14 nt, Homo sapiens
ucaguccucuuuca

SEQ ID NO: 52316 - RNA, 13 nt, Homo sapiens
ucaguuauuuuua

SEQ ID NO: 52317 - RNA, 23 nt, Homo sapiens
ucaguuguuauuuauugaaauga

SEQ ID NO: 52318 - RNA, 15 nt, Homo sapiens
ucauaagaauucugu

SEQ ID NO: 52319 - RNA, 16 nt, Homo sapiens
ucauaauaaauaucua

SEQ ID NO: 52320 - RNA, 13 nt, Homo sapiens
ucauauuuaauuu

SEQ ID NO: 52321 - RNA, 16 nt, Homo sapiens
ucauauuuaauuugaa

SEQ ID NO: 52322 - RNA, 16 nt, Homo sapiens
ucauauuuauagccag

SEQ ID NO: 52323 - RNA, 12 nt, Homo sapiens
ucauauuuucau

SEQ ID NO: 52324 - RNA, 15 nt, Homo sapiens
ucaucaaugaaugaa

SEQ ID NO: 52325 - RNA, 16 nt, Homo sapiens
ucaucaaugaaugaau

SEQ ID NO: 52326 - RNA, 14 nt, Homo sapiens
ucaucacccagcac

SEQ ID NO: 52327 - RNA, 14 nt, Homo sapiens
ucauccacuuucca

SEQ ID NO: 52328 - RNA, 15 nt, Homo sapiens
ucauccacuuuccaa

SEQ ID NO: 52329 - RNA, 13 nt, Homo sapiens
ucaucccacccgc

SEQ ID NO: 52330 - RNA, 21 nt, Homo sapiens
ucaucuguaaaauggagacac

SEQ ID NO: 52331 - RNA, 23 nt, Homo sapiens
ucaucugugauucccuccugcua

SEQ ID NO: 52332 - RNA, 18 nt, Homo sapiens
ucaucuuggucacauaca

SEQ ID NO: 52333 - RNA, 19 nt, Homo sapiens
ucaucuuggucacauacaa

SEQ ID NO: 52334 - RNA, 14 nt, Homo sapiens
ucaugaaggggcgg

SEQ ID NO: 52335 - RNA, 15 nt, Homo sapiens
ucaugaaggggcggc

SEQ ID NO: 52336 - RNA, 20 nt, Homo sapiens
ucaugaaggggcggcggccc

SEQ ID NO: 52337 - RNA, 12 nt, Homo sapiens
ucaugaauuagu

SEQ ID NO: 52338 - RNA, 19 nt, Homo sapiens
ucaugaauuaguuuuauau

SEQ ID NO: 52339 - RNA, 16 nt, Homo sapiens
ucaugcaaaugcugua

SEQ ID NO: 52340 - RNA, 14 nt, Homo sapiens
ucaugcauuugcac

SEQ ID NO: 52341 - RNA, 12 nt, Homo sapiens
ucaugcugccaa

SEQ ID NO: 52342 - RNA, 13 nt, Homo sapiens
ucauguacaucca

SEQ ID NO: 52343 - RNA, 14 nt, Homo sapiens
ucauguugaaacuu

SEQ ID NO: 52344 - RNA, 13 nt, Homo sapiens
ucauuaaaguucu

SEQ ID NO: 52345 - RNA, 15 nt, Homo sapiens
ucauuaaaguucuag

SEQ ID NO: 52346 - RNA, 19 nt, Homo sapiens
ucauuaaaguucuagugac

SEQ ID NO: 52347 - RNA, 22 nt, Homo sapiens
ucauuaaaguucuagugaccga

SEQ ID NO: 52348 - RNA, 21 nt, Homo sapiens
ucauuaaauggaaguaaaugu

SEQ ID NO: 52349 - RNA, 22 nt, Homo sapiens
ucauuaaauggaaguaaauguu

SEQ ID NO: 52350 - RNA, 17 nt, Homo sapiens
ucauuaauaauaaauuc

SEQ ID NO: 52351 - RNA, 18 nt, Homo sapiens
ucauuaguuuugaagauu

SEQ ID NO: 52352 - RNA, 19 nt, Homo sapiens
ucauuaucucaaaacugca

SEQ ID NO: 52353 - RNA, 20 nt, Homo sapiens
ucauuaucucaaaacugcac

SEQ ID NO: 52354 - RNA, 14 nt, Homo sapiens
ucauuauguuaaua

SEQ ID NO: 52355 - RNA, 20 nt, Homo sapiens
ucauucagauaugauucaaa

SEQ ID NO: 52356 - RNA, 15 nt, Homo sapiens
ucauucugccugccc

SEQ ID NO: 52357 - RNA, 17 nt, Homo sapiens
ucauucuuuuugaaaug

SEQ ID NO: 52358 - RNA, 21 nt, Homo sapiens
ucauucuuuuugaaaugucaa

SEQ ID NO: 52359 - RNA, 16 nt, Homo sapiens
ucauugcaaccuccac

SEQ ID NO: 52360 - RNA, 22 nt, Homo sapiens
ucauuguucuugugaacccaaa

SEQ ID NO: 52361 - RNA, 13 nt, Homo sapiens
ucauuuauuucca

SEQ ID NO: 52362 - RNA, 13 nt, Homo sapiens
ucauuuccaagca

SEQ ID NO: 52363 - RNA, 21 nt, Homo sapiens
ucauuuccuauguaacugcau

SEQ ID NO: 52364 - RNA, 20 nt, Homo sapiens
ucauuuuaaaaaauggaaca

SEQ ID NO: 52365 - RNA, 15 nt, Homo sapiens
ucauuuuuuuuaaga

SEQ ID NO: 52366 - RNA, 22 nt, Homo sapiens
uccaaacugacucuuaagaaga

SEQ ID NO: 52367 - RNA, 21 nt, Homo sapiens
uccaaagaaauguaagggaaa

SEQ ID NO: 52368 - RNA, 22 nt, Homo sapiens
uccaaagcugaauacauucugc

SEQ ID NO: 52369 - RNA, 14 nt, Homo sapiens
uccaaauucacaag

SEQ ID NO: 52370 - RNA, 19 nt, Homo sapiens
uccaacuaucucauuucca

SEQ ID NO: 52371 - RNA, 14 nt, Homo sapiens
uccaagcaaguauu

SEQ ID NO: 52372 - RNA, 14 nt, Homo sapiens
uccaagcauaccaa

SEQ ID NO: 52373 - RNA, 22 nt, Homo sapiens
uccaagcauaccaacacgagca

SEQ ID NO: 52374 - RNA, 16 nt, Homo sapiens
uccaagccucaugucc

SEQ ID NO: 52375 - RNA, 22 nt, Homo sapiens
uccaauaaagaguuccuucugc

SEQ ID NO: 52376 - RNA, 24 nt, Homo sapiens
uccaauuaaggauuuuaugcuuua

SEQ ID NO: 52377 - RNA, 19 nt, Homo sapiens
uccacauccugugggaccu

SEQ ID NO: 52378 - RNA, 17 nt, Homo sapiens
uccaccuuacuucuucu

SEQ ID NO: 52379 - RNA, 13 nt, Homo sapiens
uccacuacugcua

SEQ ID NO: 52380 - RNA, 16 nt, Homo sapiens
uccacuuuccaauaaa

SEQ ID NO: 52381 - RNA, 12 nt, Homo sapiens
uccagcugcccc

SEQ ID NO: 52382 - RNA, 14 nt, Homo sapiens
uccagcugccccgg

SEQ ID NO: 52383 - RNA, 15 nt, Homo sapiens
uccagcugccccggg

SEQ ID NO: 52384 - RNA, 17 nt, Homo sapiens
uccagcugccccgggga

SEQ ID NO: 52385 - RNA, 17 nt, Homo sapiens
uccagggcuacgcgcgc

SEQ ID NO: 52386 - RNA, 19 nt, Homo sapiens
uccagggcuacgcgcgcuc

SEQ ID NO: 52387 - RNA, 20 nt, Homo sapiens
uccagggcuacgcgcgcucc

SEQ ID NO: 52388 - RNA, 21 nt, Homo sapiens
uccagggcuacgcgcgcuccg

SEQ ID NO: 52389 - RNA, 18 nt, Homo sapiens
uccagguuccugagcccu

SEQ ID NO: 52390 - RNA, 19 nt, Homo sapiens
uccagugagacagcucugc

SEQ ID NO: 52391 - RNA, 20 nt, Homo sapiens
uccagugagacagcucugca

SEQ ID NO: 52392 - RNA, 18 nt, Homo sapiens
uccauggcccugccaugc

SEQ ID NO: 52393 - RNA, 16 nt, Homo sapiens
uccauggggugggggu

SEQ ID NO: 52394 - RNA, 14 nt, Homo sapiens
uccauuaaauauaa

SEQ ID NO: 52395 - RNA, 16 nt, Homo sapiens
uccauuaaauauaaag

SEQ ID NO: 52396 - RNA, 19 nt, Homo sapiens
uccauugguuuaccuguga

SEQ ID NO: 52397 - RNA, 16 nt, Homo sapiens
ucccaaaacugauacc

SEQ ID NO: 52398 - RNA, 19 nt, Homo sapiens
ucccaaauuucauaccuau

SEQ ID NO: 52399 - RNA, 21 nt, Homo sapiens
ucccaaauuucauaccuauca

SEQ ID NO: 52400 - RNA, 12 nt, Homo sapiens
ucccacacuguc

SEQ ID NO: 52401 - RNA, 14 nt, Homo sapiens
ucccacacugucca

SEQ ID NO: 52402 - RNA, 13 nt, Homo sapiens
ucccacccgccca

SEQ ID NO: 52403 - RNA, 17 nt, Homo sapiens
ucccacccgcccaccgc

SEQ ID NO: 52404 - RNA, 18 nt, Homo sapiens
ucccacccgcccaccgca

SEQ ID NO: 52405 - RNA, 17 nt, Homo sapiens
ucccaccucccauucac

SEQ ID NO: 52406 - RNA, 20 nt, Homo sapiens
ucccagcacuuugggaggcu

SEQ ID NO: 52407 - RNA, 19 nt, Homo sapiens
ucccagcuacuugggaggc

SEQ ID NO: 52408 - RNA, 17 nt, Homo sapiens
ucccagcuagaauucac

SEQ ID NO: 52409 - RNA, 23 nt, Homo sapiens
ucccagcuagaauucacuccacu

SEQ ID NO: 52410 - RNA, 21 nt, Homo sapiens
ucccaggaaaauuaaggcuuc

SEQ ID NO: 52411 - RNA, 15 nt, Homo sapiens
ucccaggaggggcuu

SEQ ID NO: 52412 - RNA, 22 nt, Homo sapiens
ucccaggaggggcuucugggca

SEQ ID NO: 52413 - RNA, 22 nt, Homo sapiens
ucccauggguuguguguuuauu

SEQ ID NO: 52414 - RNA, 15 nt, Homo sapiens
ucccauucacagaua

SEQ ID NO: 52415 - RNA, 19 nt, Homo sapiens
ucccauucacagauaccuc

SEQ ID NO: 52416 - RNA, 16 nt, Homo sapiens
ucccauucaggaugcc

SEQ ID NO: 52417 - RNA, 15 nt, Homo sapiens
uccccagagcuacag

SEQ ID NO: 52418 - RNA, 17 nt, Homo sapiens
uccccagagcuacaggc

SEQ ID NO: 52419 - RNA, 16 nt, Homo sapiens
uccccagcuguuuaug

SEQ ID NO: 52420 - RNA, 16 nt, Homo sapiens
uccccaugauguuuag

SEQ ID NO: 52421 - RNA, 14 nt, Homo sapiens
uccccgaaacuacc

SEQ ID NO: 52422 - RNA, 13 nt, Homo sapiens
uccccucggagaa

SEQ ID NO: 52423 - RNA, 17 nt, Homo sapiens
uccccugucacgugugg

SEQ ID NO: 52424 - RNA, 15 nt, Homo sapiens
uccccuucccacacu

SEQ ID NO: 52425 - RNA, 17 nt, Homo sapiens
ucccgcuguuccucgcc

SEQ ID NO: 52426 - RNA, 19 nt, Homo sapiens
ucccgcuguuccucgccac

SEQ ID NO: 52427 - RNA, 12 nt, Homo sapiens
ucccggccgcgc

SEQ ID NO: 52428 - RNA, 14 nt, Homo sapiens
ucccggccgcgcug

SEQ ID NO: 52429 - RNA, 15 nt, Homo sapiens
ucccggccgcgcugc

SEQ ID NO: 52430 - RNA, 16 nt, Homo sapiens
ucccggccgcgcugcg

SEQ ID NO: 52431 - RNA, 17 nt, Homo sapiens
ucccggccgcgcugcgc

SEQ ID NO: 52432 - RNA, 20 nt, Homo sapiens
ucccggccgcgcugcgcgcc

SEQ ID NO: 52433 - RNA, 23 nt, Homo sapiens
ucccggccgcgcugcgcgccgcg

SEQ ID NO: 52434 - RNA, 24 nt, Homo sapiens
ucccggccgcgcugcgcgccgcgc

SEQ ID NO: 52435 - RNA, 12 nt, Homo sapiens
ucccggccggcg

SEQ ID NO: 52436 - RNA, 15 nt, Homo sapiens
ucccggccggcgcgc

SEQ ID NO: 52437 - RNA, 16 nt, Homo sapiens
ucccggccggcgcgcu

SEQ ID NO: 52438 - RNA, 22 nt, Homo sapiens
ucccuauuuuuuuucuguuaua

SEQ ID NO: 52439 - RNA, 19 nt, Homo sapiens
ucccucuaauuuaucuugu

SEQ ID NO: 52440 - RNA, 18 nt, Homo sapiens
ucccucuguugccaaggc

SEQ ID NO: 52441 - RNA, 22 nt, Homo sapiens
ucccucuguugccaaggcugga

SEQ ID NO: 52442 - RNA, 13 nt, Homo sapiens
ucccugagcagga

SEQ ID NO: 52443 - RNA, 15 nt, Homo sapiens
ucccugcagacauga

SEQ ID NO: 52444 - RNA, 16 nt, Homo sapiens
ucccugcagacaugag

SEQ ID NO: 52445 - RNA, 23 nt, Homo sapiens
ucccuggaagagaucaagccauc

SEQ ID NO: 52446 - RNA, 13 nt, Homo sapiens
ucccuuaccuggg

SEQ ID NO: 52447 - RNA, 14 nt, Homo sapiens
ucccuuaccuggga

SEQ ID NO: 52448 - RNA, 19 nt, Homo sapiens
ucccuucucuucacaguca

SEQ ID NO: 52449 - RNA, 15 nt, Homo sapiens
uccgaagucuuccau

SEQ ID NO: 52450 - RNA, 13 nt, Homo sapiens
uccgcauccuagu

SEQ ID NO: 52451 - RNA, 15 nt, Homo sapiens
uccgcauccuagucu

SEQ ID NO: 52452 - RNA, 12 nt, Homo sapiens
uccgcgcagcuc

SEQ ID NO: 52453 - RNA, 16 nt, Homo sapiens
uccgcgcagcucaggc

SEQ ID NO: 52454 - RNA, 18 nt, Homo sapiens
uccgcgcagcucaggcug

SEQ ID NO: 52455 - RNA, 19 nt, Homo sapiens
uccgcgcagcucaggcugg

SEQ ID NO: 52456 - RNA, 20 nt, Homo sapiens
uccgcgcagcucaggcuggc

SEQ ID NO: 52457 - RNA, 12 nt, Homo sapiens
uccgcuacuucc

SEQ ID NO: 52458 - RNA, 17 nt, Homo sapiens
uccgcuacuuccagggc

SEQ ID NO: 52459 - RNA, 18 nt, Homo sapiens
uccgcuacuuccagggcu

SEQ ID NO: 52460 - RNA, 21 nt, Homo sapiens
uccgcuauccaccaaaagggc

SEQ ID NO: 52461 - RNA, 12 nt, Homo sapiens
uccggacgcugc

SEQ ID NO: 52462 - RNA, 12 nt, Homo sapiens
uccgggucgcag

SEQ ID NO: 52463 - RNA, 20 nt, Homo sapiens
uccgggucgcaggaccaucc

SEQ ID NO: 52464 - RNA, 20 nt, Homo sapiens
uccguggcacugcauacaau

SEQ ID NO: 52465 - RNA, 17 nt, Homo sapiens
uccguuaaaauaccagc

SEQ ID NO: 52466 - RNA, 19 nt, Homo sapiens
uccuaacaggaauuuucau

SEQ ID NO: 52467 - RNA, 17 nt, Homo sapiens
uccuaagucccugcugc

SEQ ID NO: 52468 - RNA, 20 nt, Homo sapiens
uccuaauaaaaaggugacca

SEQ ID NO: 52469 - RNA, 21 nt, Homo sapiens
uccuagcgcagccaugugauu

SEQ ID NO: 52470 - RNA, 23 nt, Homo sapiens
uccuagcgcagccaugugauuac

SEQ ID NO: 52471 - RNA, 14 nt, Homo sapiens
uccuagucucuauc

SEQ ID NO: 52472 - RNA, 14 nt, Homo sapiens
uccuagugaaagag

SEQ ID NO: 52473 - RNA, 12 nt, Homo sapiens
uccuauauccug

SEQ ID NO: 52474 - RNA, 15 nt, Homo sapiens
uccuauguaacugca

SEQ ID NO: 52475 - RNA, 15 nt, Homo sapiens
uccuauuauauucau

SEQ ID NO: 52476 - RNA, 17 nt, Homo sapiens
uccuccaugaauaucag

SEQ ID NO: 52477 - RNA, 22 nt, Homo sapiens
uccuccaugaauaucaguuauu

SEQ ID NO: 52478 - RNA, 12 nt, Homo sapiens
uccucccggccg

SEQ ID NO: 52479 - RNA, 13 nt, Homo sapiens
uccucccggccgc

SEQ ID NO: 52480 - RNA, 14 nt, Homo sapiens
uccucccggccgcg

SEQ ID NO: 52481 - RNA, 16 nt, Homo sapiens
uccucccggccgcgcu

SEQ ID NO: 52482 - RNA, 21 nt, Homo sapiens
uccucccggccgcgcugcgcg

SEQ ID NO: 52483 - RNA, 12 nt, Homo sapiens
uccucgccacgc

SEQ ID NO: 52484 - RNA, 13 nt, Homo sapiens
uccucgccacgcu

SEQ ID NO: 52485 - RNA, 18 nt, Homo sapiens
uccucgccacgcucuggg

SEQ ID NO: 52486 - RNA, 12 nt, Homo sapiens
uccucggacggc

SEQ ID NO: 52487 - RNA, 22 nt, Homo sapiens
uccucggacggcuccggacgcu

SEQ ID NO: 52488 - RNA, 20 nt, Homo sapiens
uccucucaaccaccuuucag

SEQ ID NO: 52489 - RNA, 13 nt, Homo sapiens
uccugagaccagc

SEQ ID NO: 52490 - RNA, 15 nt, Homo sapiens
uccugagaccagcca

SEQ ID NO: 52491 - RNA, 17 nt, Homo sapiens
uccugagaccagccaac

SEQ ID NO: 52492 - RNA, 18 nt, Homo sapiens
uccugagaccagccaacc

SEQ ID NO: 52493 - RNA, 15 nt, Homo sapiens
uccugcaaugaaguc

SEQ ID NO: 52494 - RNA, 23 nt, Homo sapiens
uccugcuacucuguuccuucaca

SEQ ID NO: 52495 - RNA, 21 nt, Homo sapiens
uccuggauuccucacuuugaa

SEQ ID NO: 52496 - RNA, 17 nt, Homo sapiens
uccuguacuuuuuccag

SEQ ID NO: 52497 - RNA, 20 nt, Homo sapiens
uccugugacugucucacuua

SEQ ID NO: 52498 - RNA, 15 nt, Homo sapiens
uccuuaucacugaca

SEQ ID NO: 52499 - RNA, 15 nt, Homo sapiens
uccuucauggcaggc

SEQ ID NO: 52500 - RNA, 17 nt, Homo sapiens
uccuuccacuuccaaga

SEQ ID NO: 52501 - RNA, 19 nt, Homo sapiens
uccuuccacuuccaagauc

SEQ ID NO: 52502 - RNA, 14 nt, Homo sapiens
uccuuccuuaucac

SEQ ID NO: 52503 - RNA, 16 nt, Homo sapiens
uccuucucaucuguga

SEQ ID NO: 52504 - RNA, 15 nt, Homo sapiens
uccuucugcccugcu

SEQ ID NO: 52505 - RNA, 16 nt, Homo sapiens
uccuucugcccugcuu

SEQ ID NO: 52506 - RNA, 14 nt, Homo sapiens
ucgaacugcuggau

SEQ ID NO: 52507 - RNA, 22 nt, Homo sapiens
ucgaacugcuggauucaaguga

SEQ ID NO: 52508 - RNA, 17 nt, Homo sapiens
ucgagcguugcuggggg

SEQ ID NO: 52509 - RNA, 18 nt, Homo sapiens
ucgagcguugcugggggg

SEQ ID NO: 52510 - RNA, 21 nt, Homo sapiens
ucgauccccugucacgugugg

SEQ ID NO: 52511 - RNA, 20 nt, Homo sapiens
ucgcaggaccaucccggccg

SEQ ID NO: 52512 - RNA, 21 nt, Homo sapiens
ucgcaggaccaucccggccgg

SEQ ID NO: 52513 - RNA, 23 nt, Homo sapiens
ucgcaggaccaucccggccggcg

SEQ ID NO: 52514 - RNA, 14 nt, Homo sapiens
ucgccacgcucugg

SEQ ID NO: 52515 - RNA, 18 nt, Homo sapiens
ucgccacgcucugggucg

SEQ ID NO: 52516 - RNA, 23 nt, Homo sapiens
ucgccacgcucugggucgccggc

SEQ ID NO: 52517 - RNA, 17 nt, Homo sapiens
ucgccaucacagcugaa

SEQ ID NO: 52518 - RNA, 19 nt, Homo sapiens
ucgcccacuuccucccggc

SEQ ID NO: 52519 - RNA, 21 nt, Homo sapiens
ucgcccacuuccucccggccg

SEQ ID NO: 52520 - RNA, 22 nt, Homo sapiens
ucgcccacuuccucccggccgc

SEQ ID NO: 52521 - RNA, 11 nt, Homo sapiens
ucgcgcgccuc

SEQ ID NO: 52522 - RNA, 13 nt, Homo sapiens
ucgcgcgccuccg

SEQ ID NO: 52523 - RNA, 15 nt, Homo sapiens
ucgcgcgccuccgcu

SEQ ID NO: 52524 - RNA, 24 nt, Homo sapiens
ucgcugauauauguguuuuucaca

SEQ ID NO: 52525 - RNA, 19 nt, Homo sapiens
ucgcuuccgcauccuaguc

SEQ ID NO: 52526 - RNA, 20 nt, Homo sapiens
ucgcuuccgcauccuagucu

SEQ ID NO: 52527 - RNA, 17 nt, Homo sapiens
ucgcuuuugauaaucaa

SEQ ID NO: 52528 - RNA, 18 nt, Homo sapiens
ucgcuuuugauaaucaac

SEQ ID NO: 52529 - RNA, 13 nt, Homo sapiens
ucggacggcuccg

SEQ ID NO: 52530 - RNA, 14 nt, Homo sapiens
ucggacggcuccgg

SEQ ID NO: 52531 - RNA, 18 nt, Homo sapiens
ucggacggcuccggacgc

SEQ ID NO: 52532 - RNA, 20 nt, Homo sapiens
ucggacggcuccggacgcug

SEQ ID NO: 52533 - RNA, 12 nt, Homo sapiens
ucggccugcucg

SEQ ID NO: 52534 - RNA, 14 nt, Homo sapiens
ucggccugcucgcc

SEQ ID NO: 52535 - RNA, 15 nt, Homo sapiens
ucggccugcucgccc

SEQ ID NO: 52536 - RNA, 16 nt, Homo sapiens
ucggccugcucgccca

SEQ ID NO: 52537 - RNA, 17 nt, Homo sapiens
ucggccugcucgcccac

SEQ ID NO: 52538 - RNA, 12 nt, Homo sapiens
ucuaaaugucaa

SEQ ID NO: 52539 - RNA, 16 nt, Homo sapiens
ucuaaauucuuucauu

SEQ ID NO: 52540 - RNA, 12 nt, Homo sapiens
ucuaacucagaa

SEQ ID NO: 52541 - RNA, 13 nt, Homo sapiens
ucuaacucagaaa

SEQ ID NO: 52542 - RNA, 18 nt, Homo sapiens
ucuaacucagaaacauca

SEQ ID NO: 52543 - RNA, 19 nt, Homo sapiens
ucuaaguaaaaccacagca

SEQ ID NO: 52544 - RNA, 16 nt, Homo sapiens
ucuacaaaauauagcu

SEQ ID NO: 52545 - RNA, 16 nt, Homo sapiens
ucuacauacuauggaa

SEQ ID NO: 52546 - RNA, 14 nt, Homo sapiens
ucuaccaaaaaucu

SEQ ID NO: 52547 - RNA, 17 nt, Homo sapiens
ucuaccuguucgcgcgc

SEQ ID NO: 52548 - RNA, 18 nt, Homo sapiens
ucuaccuguucgcgcgcc

SEQ ID NO: 52549 - RNA, 19 nt, Homo sapiens
ucuaccuguucgcgcgccu

SEQ ID NO: 52550 - RNA, 23 nt, Homo sapiens
ucuaccuguucgcgcgccuccgc

SEQ ID NO: 52551 - RNA, 15 nt, Homo sapiens
ucuagaauacuaaua

SEQ ID NO: 52552 - RNA, 16 nt, Homo sapiens
ucuagauacuguauca

SEQ ID NO: 52553 - RNA, 21 nt, Homo sapiens
ucuagcaaauguuaugcauaa

SEQ ID NO: 52554 - RNA, 13 nt, Homo sapiens
ucuaggccgggcg

SEQ ID NO: 52555 - RNA, 14 nt, Homo sapiens
ucuaggccgggcgc

SEQ ID NO: 52556 - RNA, 17 nt, Homo sapiens
ucuaggccgggcgcggu

SEQ ID NO: 52557 - RNA, 19 nt, Homo sapiens
ucuaguuugauuaaauucu

SEQ ID NO: 52558 - RNA, 20 nt, Homo sapiens
ucuauaaaccgaacugaugu

SEQ ID NO: 52559 - RNA, 22 nt, Homo sapiens
ucuaucauuaaaguucuaguga

SEQ ID NO: 52560 - RNA, 15 nt, Homo sapiens
ucuaucccaaccucu

SEQ ID NO: 52561 - RNA, 19 nt, Homo sapiens
ucuaugaaauauuauguua

SEQ ID NO: 52562 - RNA, 16 nt, Homo sapiens
ucuaugacacaugcaa

SEQ ID NO: 52563 - RNA, 17 nt, Homo sapiens
ucuaugagggcuaauau

SEQ ID NO: 52564 - RNA, 15 nt, Homo sapiens
ucuauguuaauauuu

SEQ ID NO: 52565 - RNA, 16 nt, Homo sapiens
ucuauuacgugcaaua

SEQ ID NO: 52566 - RNA, 12 nt, Homo sapiens
ucuauugccaug

SEQ ID NO: 52567 - RNA, 15 nt, Homo sapiens
ucucacaagcacuuu

SEQ ID NO: 52568 - RNA, 19 nt, Homo sapiens
ucucaccucccaacguccc

SEQ ID NO: 52569 - RNA, 15 nt, Homo sapiens
ucucaccugugagac

SEQ ID NO: 52570 - RNA, 23 nt, Homo sapiens
ucucaggaaaucaaauaugcaaa

SEQ ID NO: 52571 - RNA, 11 nt, Homo sapiens
ucucagugucc

SEQ ID NO: 52572 - RNA, 14 nt, Homo sapiens
ucucaguugcagcc

SEQ ID NO: 52573 - RNA, 21 nt, Homo sapiens
ucucaguugcagcccugcugc

SEQ ID NO: 52574 - RNA, 13 nt, Homo sapiens
ucucauccacuuu

SEQ ID NO: 52575 - RNA, 14 nt, Homo sapiens
ucucaucugugauu

SEQ ID NO: 52576 - RNA, 20 nt, Homo sapiens
ucuccagucauuauguuaau

SEQ ID NO: 52577 - RNA, 13 nt, Homo sapiens
ucuccaugauccc

SEQ ID NO: 52578 - RNA, 22 nt, Homo sapiens
ucuccaugaucccaccucccau

SEQ ID NO: 52579 - RNA, 18 nt, Homo sapiens
ucuccauggcccugccau

SEQ ID NO: 52580 - RNA, 20 nt, Homo sapiens
ucuccauggcccugccaugc

SEQ ID NO: 52581 - RNA, 17 nt, Homo sapiens
ucucccaaagugcuggg

SEQ ID NO: 52582 - RNA, 18 nt, Homo sapiens
ucucccaaagugcuggga

SEQ ID NO: 52583 - RNA, 20 nt, Homo sapiens
ucucccucuguugccaaggc

SEQ ID NO: 52584 - RNA, 16 nt, Homo sapiens
ucuccgucucccaaag

SEQ ID NO: 52585 - RNA, 12 nt, Homo sapiens
ucuccuuggaua

SEQ ID NO: 52586 - RNA, 18 nt, Homo sapiens
ucucgaacugcuggauuc

SEQ ID NO: 52587 - RNA, 18 nt, Homo sapiens
ucucgugguaggacugua

SEQ ID NO: 52588 - RNA, 13 nt, Homo sapiens
ucucuaacucaga

SEQ ID NO: 52589 - RNA, 15 nt, Homo sapiens
ucucuaacucagaaa

SEQ ID NO: 52590 - RNA, 13 nt, Homo sapiens
ucucuaggaaaua

SEQ ID NO: 52591 - RNA, 16 nt, Homo sapiens
ucucuaggaaauauuu

SEQ ID NO: 52592 - RNA, 19 nt, Homo sapiens
ucucuagucauuuguuaau

SEQ ID NO: 52593 - RNA, 12 nt, Homo sapiens
ucucuaucauua

SEQ ID NO: 52594 - RNA, 22 nt, Homo sapiens
ucucuccucuccccaugauguu

SEQ ID NO: 52595 - RNA, 18 nt, Homo sapiens
ucucugaagugaaacugc

SEQ ID NO: 52596 - RNA, 15 nt, Homo sapiens
ucucugccuugguau

SEQ ID NO: 52597 - RNA, 14 nt, Homo sapiens
ucucuucuuuaaag

SEQ ID NO: 52598 - RNA, 16 nt, Homo sapiens
ucucuuguagcucucu

SEQ ID NO: 52599 - RNA, 15 nt, Homo sapiens
ucucuuuauucagcc

SEQ ID NO: 52600 - RNA, 19 nt, Homo sapiens
ucugagaaagacuauucaa

SEQ ID NO: 52601 - RNA, 13 nt, Homo sapiens
ucugauaccucaa

SEQ ID NO: 52602 - RNA, 18 nt, Homo sapiens
ucugauuuuccuggacag

SEQ ID NO: 52603 - RNA, 21 nt, Homo sapiens
ucugauuuuccuggacaguuu

SEQ ID NO: 52604 - RNA, 24 nt, Homo sapiens
ucugcagcaauaaagcagcguuuc

SEQ ID NO: 52605 - RNA, 23 nt, Homo sapiens
ucugcccauccugccccugagcc

SEQ ID NO: 52606 - RNA, 23 nt, Homo sapiens
ucugcccugcuuuugcuagguca

SEQ ID NO: 52607 - RNA, 14 nt, Homo sapiens
ucugccugcccuga

SEQ ID NO: 52608 - RNA, 22 nt, Homo sapiens
ucugccugcccugaaaguccca

SEQ ID NO: 52609 - RNA, 13 nt, Homo sapiens
ucugcuaugcuau

SEQ ID NO: 52610 - RNA, 18 nt, Homo sapiens
ucugcuauuugcuguuau

SEQ ID NO: 52611 - RNA, 16 nt, Homo sapiens
ucugcuuuaauuucau

SEQ ID NO: 52612 - RNA, 12 nt, Homo sapiens
ucuggaaaccac

SEQ ID NO: 52613 - RNA, 19 nt, Homo sapiens
ucuggaagccucuauugcc

SEQ ID NO: 52614 - RNA, 16 nt, Homo sapiens
ucuggaggucucugaa

SEQ ID NO: 52615 - RNA, 17 nt, Homo sapiens
ucuggcugcugguggcg

SEQ ID NO: 52616 - RNA, 22 nt, Homo sapiens
ucuggcugcugguggcgcuggc

SEQ ID NO: 52617 - RNA, 12 nt, Homo sapiens
ucugggucgccg

SEQ ID NO: 52618 - RNA, 14 nt, Homo sapiens
ucugggucgccggc

SEQ ID NO: 52619 - RNA, 15 nt, Homo sapiens
ucugggucgccggca

SEQ ID NO: 52620 - RNA, 16 nt, Homo sapiens
ucugggucgccggcau

SEQ ID NO: 52621 - RNA, 17 nt, Homo sapiens
ucugggucgccggcauc

SEQ ID NO: 52622 - RNA, 17 nt, Homo sapiens
ucugggucucagugucc

SEQ ID NO: 52623 - RNA, 14 nt, Homo sapiens
ucuggguucaagcg

SEQ ID NO: 52624 - RNA, 19 nt, Homo sapiens
ucugguccuaagucccugc

SEQ ID NO: 52625 - RNA, 22 nt, Homo sapiens
ucuguaaaauggagacaccacc

SEQ ID NO: 52626 - RNA, 12 nt, Homo sapiens
ucuguaaucuuc

SEQ ID NO: 52627 - RNA, 17 nt, Homo sapiens
ucugucuggacuuucca

SEQ ID NO: 52628 - RNA, 21 nt, Homo sapiens
ucugucuggacuuuccagaga

SEQ ID NO: 52629 - RNA, 17 nt, Homo sapiens
ucuguuuuauaauuuug

SEQ ID NO: 52630 - RNA, 21 nt, Homo sapiens
ucuuaaacacuaaaaaggcau

SEQ ID NO: 52631 - RNA, 13 nt, Homo sapiens
ucuuaacuugaag

SEQ ID NO: 52632 - RNA, 16 nt, Homo sapiens
ucuuaaguagggacuu

SEQ ID NO: 52633 - RNA, 17 nt, Homo sapiens
ucuuaauucuuagcuca

SEQ ID NO: 52634 - RNA, 15 nt, Homo sapiens
ucuuaguaugugcau

SEQ ID NO: 52635 - RNA, 22 nt, Homo sapiens
ucuuaguaugugcauuuaauua

SEQ ID NO: 52636 - RNA, 13 nt, Homo sapiens
ucuucacaacaga

SEQ ID NO: 52637 - RNA, 18 nt, Homo sapiens
ucuucacaacagauuauu

SEQ ID NO: 52638 - RNA, 13 nt, Homo sapiens
ucuucacuugguu

SEQ ID NO: 52639 - RNA, 14 nt, Homo sapiens
ucuucauaccuaca

SEQ ID NO: 52640 - RNA, 19 nt, Homo sapiens
ucuucccuuuuacauacug

SEQ ID NO: 52641 - RNA, 23 nt, Homo sapiens
ucuucccuuuuacauacugcugu

SEQ ID NO: 52642 - RNA, 22 nt, Homo sapiens
ucuucuuucaugaaggggcggc

SEQ ID NO: 52643 - RNA, 13 nt, Homo sapiens
ucuugaaagcugu

SEQ ID NO: 52644 - RNA, 22 nt, Homo sapiens
ucuugaaauauaggaacuuaaa

SEQ ID NO: 52645 - RNA, 21 nt, Homo sapiens
ucuugaauuguaggugacuau

SEQ ID NO: 52646 - RNA, 21 nt, Homo sapiens
ucuugauugugggauacuauu

SEQ ID NO: 52647 - RNA, 21 nt, Homo sapiens
ucuugcaauucaauacagauc

SEQ ID NO: 52648 - RNA, 13 nt, Homo sapiens
ucuuggggaauau

SEQ ID NO: 52649 - RNA, 20 nt, Homo sapiens
ucuugugaacccaaagugug

SEQ ID NO: 52650 - RNA, 23 nt, Homo sapiens
ucuuucaagggaccucuccauga

SEQ ID NO: 52651 - RNA, 20 nt, Homo sapiens
ucuuucaugaaggggcggcg

SEQ ID NO: 52652 - RNA, 18 nt, Homo sapiens
ucuuuccaaaguacacug

SEQ ID NO: 52653 - RNA, 21 nt, Homo sapiens
ucuuuuuagagaaauuugcca

SEQ ID NO: 52654 - RNA, 19 nt, Homo sapiens
ucuuuuuccagguuccuga

SEQ ID NO: 52655 - RNA, 20 nt, Homo sapiens
ucuuuuuuuuaauaaaccau

SEQ ID NO: 52656 - RNA, 22 nt, Homo sapiens
ugaaaaaaaauuuuauaguguc

SEQ ID NO: 52657 - RNA, 19 nt, Homo sapiens
ugaaaaaguucugcagaua

SEQ ID NO: 52658 - RNA, 21 nt, Homo sapiens
ugaaaacauagcaucucagga

SEQ ID NO: 52659 - RNA, 19 nt, Homo sapiens
ugaaaacuuuaugcuaagu

SEQ ID NO: 52660 - RNA, 16 nt, Homo sapiens
ugaaaagacuccaaag

SEQ ID NO: 52661 - RNA, 17 nt, Homo sapiens
ugaaaauauuuguauca

SEQ ID NO: 52662 - RNA, 21 nt, Homo sapiens
ugaaaaucuacacuccaguga

SEQ ID NO: 52663 - RNA, 23 nt, Homo sapiens
ugaaaaucuacacuccagugaga

SEQ ID NO: 52664 - RNA, 16 nt, Homo sapiens
ugaaaaugaauaucua

SEQ ID NO: 52665 - RNA, 12 nt, Homo sapiens
ugaaaaugucau

SEQ ID NO: 52666 - RNA, 23 nt, Homo sapiens
ugaaacugagaugugaacacauc

SEQ ID NO: 52667 - RNA, 16 nt, Homo sapiens
ugaaagucccagauca

SEQ ID NO: 52668 - RNA, 21 nt, Homo sapiens
ugaaagucccagaucaagccu

SEQ ID NO: 52669 - RNA, 23 nt, Homo sapiens
ugaaauaagccagacaucaacag

SEQ ID NO: 52670 - RNA, 20 nt, Homo sapiens
ugaacaacucgaaucacuca

SEQ ID NO: 52671 - RNA, 15 nt, Homo sapiens
ugaacacaaagccug

SEQ ID NO: 52672 - RNA, 14 nt, Homo sapiens
ugaacacaucagcu

SEQ ID NO: 52673 - RNA, 15 nt, Homo sapiens
ugaacacaucagcuu

SEQ ID NO: 52674 - RNA, 17 nt, Homo sapiens
ugaacacaucagcuugc

SEQ ID NO: 52675 - RNA, 19 nt, Homo sapiens
ugaacacuuauaagugaag

SEQ ID NO: 52676 - RNA, 16 nt, Homo sapiens
ugaacaggauauucuc

SEQ ID NO: 52677 - RNA, 21 nt, Homo sapiens
ugaacaguuguguuugaagca

SEQ ID NO: 52678 - RNA, 11 nt, Homo sapiens
ugaacauucca

SEQ ID NO: 52679 - RNA, 19 nt, Homo sapiens
ugaaccguuugugauugcc

SEQ ID NO: 52680 - RNA, 18 nt, Homo sapiens
ugaacuagaguuuagcug

SEQ ID NO: 52681 - RNA, 21 nt, Homo sapiens
ugaacuagaguuuagcuggaa

SEQ ID NO: 52682 - RNA, 13 nt, Homo sapiens
ugaacugcagcga

SEQ ID NO: 52683 - RNA, 22 nt, Homo sapiens
ugaacugcagcgaguacuuccc

SEQ ID NO: 52684 - RNA, 21 nt, Homo sapiens
ugaacuuuuuguuuuguuucu

SEQ ID NO: 52685 - RNA, 14 nt, Homo sapiens
ugaagaaacauuua

SEQ ID NO: 52686 - RNA, 13 nt, Homo sapiens
ugaagauacugaa

SEQ ID NO: 52687 - RNA, 15 nt, Homo sapiens
ugaagauacugaaau

SEQ ID NO: 52688 - RNA, 16 nt, Homo sapiens
ugaagauacugaaaua

SEQ ID NO: 52689 - RNA, 21 nt, Homo sapiens
ugaagauacugaaauaaacgu

SEQ ID NO: 52690 - RNA, 22 nt, Homo sapiens
ugaagauagaagguuugcagau

SEQ ID NO: 52691 - RNA, 15 nt, Homo sapiens
ugaagcaaaauuuuu

SEQ ID NO: 52692 - RNA, 14 nt, Homo sapiens
ugaagcuuuaagaa

SEQ ID NO: 52693 - RNA, 13 nt, Homo sapiens
ugaaggggcggcg

SEQ ID NO: 52694 - RNA, 14 nt, Homo sapiens
ugaaggggcggcgg

SEQ ID NO: 52695 - RNA, 15 nt, Homo sapiens
ugaaggggcggcggc

SEQ ID NO: 52696 - RNA, 17 nt, Homo sapiens
ugaaguaauaugcacac

SEQ ID NO: 52697 - RNA, 21 nt, Homo sapiens
ugaaguccaagcauuuagaug

SEQ ID NO: 52698 - RNA, 18 nt, Homo sapiens
ugaagucucugaagugaa

SEQ ID NO: 52699 - RNA, 16 nt, Homo sapiens
ugaaguuuaauugacu

SEQ ID NO: 52700 - RNA, 15 nt, Homo sapiens
ugaauaaaguguaag

SEQ ID NO: 52701 - RNA, 22 nt, Homo sapiens
ugaauaaaguguaaguucacaa

SEQ ID NO: 52702 - RNA, 15 nt, Homo sapiens
ugaauaucaguuauu

SEQ ID NO: 52703 - RNA, 14 nt, Homo sapiens
ugaaugugucaggu

SEQ ID NO: 52704 - RNA, 23 nt, Homo sapiens
ugaauuaaguuuuuuuuuaaaaa

SEQ ID NO: 52705 - RNA, 15 nt, Homo sapiens
ugaauuacauuugua

SEQ ID NO: 52706 - RNA, 14 nt, Homo sapiens
ugaauucccugccu

SEQ ID NO: 52707 - RNA, 12 nt, Homo sapiens
ugacaacuguga

SEQ ID NO: 52708 - RNA, 14 nt, Homo sapiens
ugacaagcucacag

SEQ ID NO: 52709 - RNA, 12 nt, Homo sapiens
ugacacaucucu

SEQ ID NO: 52710 - RNA, 15 nt, Homo sapiens
ugacacuagcuaaua

SEQ ID NO: 52711 - RNA, 19 nt, Homo sapiens
ugacacuagcuaauaucaa

SEQ ID NO: 52712 - RNA, 18 nt, Homo sapiens
ugacagcccaaggguggg

SEQ ID NO: 52713 - RNA, 16 nt, Homo sapiens
ugacauaucacauguc

SEQ ID NO: 52714 - RNA, 16 nt, Homo sapiens
ugacaucucugcaauc

SEQ ID NO: 52715 - RNA, 20 nt, Homo sapiens
ugaccaauaaccaugcccaa

SEQ ID NO: 52716 - RNA, 13 nt, Homo sapiens
ugaccacugcaga

SEQ ID NO: 52717 - RNA, 15 nt, Homo sapiens
ugaccacugcagaag

SEQ ID NO: 52718 - RNA, 13 nt, Homo sapiens
ugacccacaagaa

SEQ ID NO: 52719 - RNA, 15 nt, Homo sapiens
ugacccugaugaaaa

SEQ ID NO: 52720 - RNA, 22 nt, Homo sapiens
ugaccuccuccuucauggcagg

SEQ ID NO: 52721 - RNA, 23 nt, Homo sapiens
ugaccuccuccuucauggcaggc

SEQ ID NO: 52722 - RNA, 14 nt, Homo sapiens
ugaccugacagccc

SEQ ID NO: 52723 - RNA, 18 nt, Homo sapiens
ugaccugacagcccaagg

SEQ ID NO: 52724 - RNA, 19 nt, Homo sapiens
ugaccugacagcccaaggg

SEQ ID NO: 52725 - RNA, 20 nt, Homo sapiens
ugacgugacuggccugcugg

SEQ ID NO: 52726 - RNA, 19 nt, Homo sapiens
ugacuaauuaggcaaggcu

SEQ ID NO: 52727 - RNA, 18 nt, Homo sapiens
ugacuauuauagaaugga

SEQ ID NO: 52728 - RNA, 22 nt, Homo sapiens
ugacuauuauauuuccaagaaa

SEQ ID NO: 52729 - RNA, 22 nt, Homo sapiens
ugacugcuaguuuauauagaaa

SEQ ID NO: 52730 - RNA, 14 nt, Homo sapiens
ugacuggccugcug

SEQ ID NO: 52731 - RNA, 17 nt, Homo sapiens
ugacuggccugcuggau

SEQ ID NO: 52732 - RNA, 15 nt, Homo sapiens
ugacugucucacuua

SEQ ID NO: 52733 - RNA, 18 nt, Homo sapiens
ugacuuaguguacaugaa

SEQ ID NO: 52734 - RNA, 16 nt, Homo sapiens
ugacuuguacucugaa

SEQ ID NO: 52735 - RNA, 18 nt, Homo sapiens
ugagaaagacuauucaaa

SEQ ID NO: 52736 - RNA, 15 nt, Homo sapiens
ugagaagaaugacua

SEQ ID NO: 52737 - RNA, 18 nt, Homo sapiens
ugagacagcucugcauac

SEQ ID NO: 52738 - RNA, 22 nt, Homo sapiens
ugagacagcucugcauacucau

SEQ ID NO: 52739 - RNA, 12 nt, Homo sapiens
ugagaccaaggc

SEQ ID NO: 52740 - RNA, 20 nt, Homo sapiens
ugagaccaaggcccccgggc

SEQ ID NO: 52741 - RNA, 14 nt, Homo sapiens
ugagaccagccaac

SEQ ID NO: 52742 - RNA, 15 nt, Homo sapiens
ugagaccagccaacc

SEQ ID NO: 52743 - RNA, 20 nt, Homo sapiens
ugagagacacacugaagaag

SEQ ID NO: 52744 - RNA, 17 nt, Homo sapiens
ugagagacagcaggucu

SEQ ID NO: 52745 - RNA, 19 nt, Homo sapiens
ugagagacagcaggucuca

SEQ ID NO: 52746 - RNA, 20 nt, Homo sapiens
ugagagcccuucaugcauuu

SEQ ID NO: 52747 - RNA, 15 nt, Homo sapiens
ugagaucaaugugac

SEQ ID NO: 52748 - RNA, 15 nt, Homo sapiens
ugagaucauugugaa

SEQ ID NO: 52749 - RNA, 14 nt, Homo sapiens
ugagcaccugcagg

SEQ ID NO: 52750 - RNA, 15 nt, Homo sapiens
ugagcagauguaaua

SEQ ID NO: 52751 - RNA, 17 nt, Homo sapiens
ugagcagucaggaaaga

SEQ ID NO: 52752 - RNA, 10 nt, Homo sapiens
ugagcccaug

SEQ ID NO: 52753 - RNA, 11 nt, Homo sapiens
ugagcccaugg

SEQ ID NO: 52754 - RNA, 16 nt, Homo sapiens
ugagccuuuguugcua

SEQ ID NO: 52755 - RNA, 13 nt, Homo sapiens
ugagcgacaguga

SEQ ID NO: 52756 - RNA, 14 nt, Homo sapiens
ugagcgacagugag

SEQ ID NO: 52757 - RNA, 19 nt, Homo sapiens
ugagcggaccuucccagcu

SEQ ID NO: 52758 - RNA, 21 nt, Homo sapiens
ugagcuaggggggucagccag

SEQ ID NO: 52759 - RNA, 20 nt, Homo sapiens
ugaggacuugggcgggacac

SEQ ID NO: 52760 - RNA, 18 nt, Homo sapiens
ugaggcauuugcagcugu

SEQ ID NO: 52761 - RNA, 20 nt, Homo sapiens
ugagguaaccucauuaucag

SEQ ID NO: 52762 - RNA, 13 nt, Homo sapiens
ugagguaccagcc

SEQ ID NO: 52763 - RNA, 16 nt, Homo sapiens
ugagguaccagccuug

SEQ ID NO: 52764 - RNA, 19 nt, Homo sapiens
ugagguacugagagugaac

SEQ ID NO: 52765 - RNA, 17 nt, Homo sapiens
ugaguacguugugcauu

SEQ ID NO: 52766 - RNA, 18 nt, Homo sapiens
ugaguacguugugcauuu

SEQ ID NO: 52767 - RNA, 16 nt, Homo sapiens
ugagugccuguaauca

SEQ ID NO: 52768 - RNA, 15 nt, Homo sapiens
ugauaccucaacccc

SEQ ID NO: 52769 - RNA, 19 nt, Homo sapiens
ugauacuuuuuucauuauu

SEQ ID NO: 52770 - RNA, 15 nt, Homo sapiens
ugauagaggcuggcg

SEQ ID NO: 52771 - RNA, 19 nt, Homo sapiens
ugauauccaaagcugaaua

SEQ ID NO: 52772 - RNA, 18 nt, Homo sapiens
ugaucagcuuauugucua

SEQ ID NO: 52773 - RNA, 18 nt, Homo sapiens
ugaucaguaugaaaaugu

SEQ ID NO: 52774 - RNA, 18 nt, Homo sapiens
ugauccugcaauuccacu

SEQ ID NO: 52775 - RNA, 15 nt, Homo sapiens
ugaucucagaaauug

SEQ ID NO: 52776 - RNA, 17 nt, Homo sapiens
ugaugauuaauucaccu

SEQ ID NO: 52777 - RNA, 12 nt, Homo sapiens
ugaugcugagcc

SEQ ID NO: 52778 - RNA, 21 nt, Homo sapiens
ugauggaaauacacuguuauc

SEQ ID NO: 52779 - RNA, 19 nt, Homo sapiens
ugauggugguauguuuuca

SEQ ID NO: 52780 - RNA, 13 nt, Homo sapiens
ugauuaaguaaug

SEQ ID NO: 52781 - RNA, 12 nt, Homo sapiens
ugauucaaaugu

SEQ ID NO: 52782 - RNA, 23 nt, Homo sapiens
ugauucauauuuaauuugaagau

SEQ ID NO: 52783 - RNA, 24 nt, Homo sapiens
ugauucauauuuaauuugaagaua

SEQ ID NO: 52784 - RNA, 22 nt, Homo sapiens
ugauucccagccagcacagccu

SEQ ID NO: 52785 - RNA, 16 nt, Homo sapiens
ugauucccuccugcua

SEQ ID NO: 52786 - RNA, 12 nt, Homo sapiens
ugauugccauuu

SEQ ID NO: 52787 - RNA, 20 nt, Homo sapiens
ugauugugggauacuauuua

SEQ ID NO: 52788 - RNA, 15 nt, Homo sapiens
ugauuucacagugug

SEQ ID NO: 52789 - RNA, 22 nt, Homo sapiens
ugauuucagcaccuacagugua

SEQ ID NO: 52790 - RNA, 15 nt, Homo sapiens
ugauuuccguuaaaa

SEQ ID NO: 52791 - RNA, 16 nt, Homo sapiens
ugauuuuauaugcuau

SEQ ID NO: 52792 - RNA, 17 nt, Homo sapiens
ugauuuuauaugcuauu

SEQ ID NO: 52793 - RNA, 14 nt, Homo sapiens
ugauuuuuguaauu

SEQ ID NO: 52794 - RNA, 18 nt, Homo sapiens
ugauuuuuguaauuuuuu

SEQ ID NO: 52795 - RNA, 19 nt, Homo sapiens
ugauuuuuguaauuuuuuu

SEQ ID NO: 52796 - RNA, 20 nt, Homo sapiens
ugcaaccccaucauccucag

SEQ ID NO: 52797 - RNA, 15 nt, Homo sapiens
ugcaacuacuaucca

SEQ ID NO: 52798 - RNA, 11 nt, Homo sapiens
ugcaagcuuuu

SEQ ID NO: 52799 - RNA, 13 nt, Homo sapiens
ugcaaggucauuu

SEQ ID NO: 52800 - RNA, 21 nt, Homo sapiens
ugcaaucuucucagaaggcaa

SEQ ID NO: 52801 - RNA, 12 nt, Homo sapiens
ugcaauuccacu

SEQ ID NO: 52802 - RNA, 14 nt, Homo sapiens
ugcacaucaaaaua

SEQ ID NO: 52803 - RNA, 17 nt, Homo sapiens
ugcacaucuguuuugua

SEQ ID NO: 52804 - RNA, 18 nt, Homo sapiens
ugcacaucuguuuuguaa

SEQ ID NO: 52805 - RNA, 16 nt, Homo sapiens
ugcaccaacuuugaag

SEQ ID NO: 52806 - RNA, 20 nt, Homo sapiens
ugcacuccagccugagcgac

SEQ ID NO: 52807 - RNA, 14 nt, Homo sapiens
ugcagaagacagua

SEQ ID NO: 52808 - RNA, 19 nt, Homo sapiens
ugcagaggccaccuggauu

SEQ ID NO: 52809 - RNA, 15 nt, Homo sapiens
ugcagauaaacagua

SEQ ID NO: 52810 - RNA, 22 nt, Homo sapiens
ugcagauaaacaguagugauag

SEQ ID NO: 52811 - RNA, 16 nt, Homo sapiens
ugcagccccugggacc

SEQ ID NO: 52812 - RNA, 11 nt, Homo sapiens
ugcagcccugc

SEQ ID NO: 52813 - RNA, 19 nt, Homo sapiens
ugcagcgaguacuucccgc

SEQ ID NO: 52814 - RNA, 21 nt, Homo sapiens
ugcagcgaguacuucccgcug

SEQ ID NO: 52815 - RNA, 16 nt, Homo sapiens
ugcaguucugaagaag

SEQ ID NO: 52816 - RNA, 23 nt, Homo sapiens
ugcauaccacuuuuguucuuggu

SEQ ID NO: 52817 - RNA, 22 nt, Homo sapiens
ugcauaggugaucucauuuaau

SEQ ID NO: 52818 - RNA, 17 nt, Homo sapiens
ugcauauuuuauuauag

SEQ ID NO: 52819 - RNA, 17 nt, Homo sapiens
ugcaugaaguaauaugc

SEQ ID NO: 52820 - RNA, 18 nt, Homo sapiens
ugcaugaaguaauaugca

SEQ ID NO: 52821 - RNA, 22 nt, Homo sapiens
ugcaugguuuagaaagcuugcc

SEQ ID NO: 52822 - RNA, 23 nt, Homo sapiens
ugcauucugagguaaccucauua

SEQ ID NO: 52823 - RNA, 18 nt, Homo sapiens
ugcauugagaacugcaua

SEQ ID NO: 52824 - RNA, 15 nt, Homo sapiens
ugccaaggcuggagu

SEQ ID NO: 52825 - RNA, 20 nt, Homo sapiens
ugccaaggcuggagugcagu

SEQ ID NO: 52826 - RNA, 18 nt, Homo sapiens
ugccaccuccugccucag

SEQ ID NO: 52827 - RNA, 16 nt, Homo sapiens
ugccagccacugugau

SEQ ID NO: 52828 - RNA, 18 nt, Homo sapiens
ugccaucauuuacuuuua

SEQ ID NO: 52829 - RNA, 12 nt, Homo sapiens
ugccaugcuggc

SEQ ID NO: 52830 - RNA, 16 nt, Homo sapiens
ugccaugcuggccagg

SEQ ID NO: 52831 - RNA, 17 nt, Homo sapiens
ugccaugcuggccaggc

SEQ ID NO: 52832 - RNA, 18 nt, Homo sapiens
ugccaugugcuaguaauu

SEQ ID NO: 52833 - RNA, 13 nt, Homo sapiens
ugcccaagaauga

SEQ ID NO: 52834 - RNA, 15 nt, Homo sapiens
ugcccacggcuggag

SEQ ID NO: 52835 - RNA, 16 nt, Homo sapiens
ugcccauccugccccu

SEQ ID NO: 52836 - RNA, 12 nt, Homo sapiens
ugccccggggag

SEQ ID NO: 52837 - RNA, 18 nt, Homo sapiens
ugccccggggaggggcgc

SEQ ID NO: 52838 - RNA, 20 nt, Homo sapiens
ugccccggggaggggcgcuc

SEQ ID NO: 52839 - RNA, 22 nt, Homo sapiens
ugccccggggaggggcgcucgc

SEQ ID NO: 52840 - RNA, 23 nt, Homo sapiens
ugccccggggaggggcgcucgcu

SEQ ID NO: 52841 - RNA, 14 nt, Homo sapiens
ugccccugagccca

SEQ ID NO: 52842 - RNA, 23 nt, Homo sapiens
ugcccugcuuuugcuaggucaca

SEQ ID NO: 52843 - RNA, 14 nt, Homo sapiens
ugcccuuacaggaa

SEQ ID NO: 52844 - RNA, 17 nt, Homo sapiens
ugcccuuccccuuccca

SEQ ID NO: 52845 - RNA, 15 nt, Homo sapiens
ugccguccccagagc

SEQ ID NO: 52846 - RNA, 13 nt, Homo sapiens
ugccgugggccug

SEQ ID NO: 52847 - RNA, 14 nt, Homo sapiens
ugccgugggccuga

SEQ ID NO: 52848 - RNA, 18 nt, Homo sapiens
ugccuaagugcagccccg

SEQ ID NO: 52849 - RNA, 19 nt, Homo sapiens
ugccuaagugcagccccgu

SEQ ID NO: 52850 - RNA, 16 nt, Homo sapiens
ugccucagaaaacaag

SEQ ID NO: 52851 - RNA, 22 nt, Homo sapiens
ugccucucucauccacuuucca

SEQ ID NO: 52852 - RNA, 12 nt, Homo sapiens
ugccugcccuga

SEQ ID NO: 52853 - RNA, 14 nt, Homo sapiens
ugccugcccugaaa

SEQ ID NO: 52854 - RNA, 15 nt, Homo sapiens
ugccuguaaucacag

SEQ ID NO: 52855 - RNA, 15 nt, Homo sapiens
ugcgccuaauguguu

SEQ ID NO: 52856 - RNA, 11 nt, Homo sapiens
ugcgcgccgcg

SEQ ID NO: 52857 - RNA, 12 nt, Homo sapiens
ugcgcgccgcgc

SEQ ID NO: 52858 - RNA, 13 nt, Homo sapiens
ugcgcgccgcgcu

SEQ ID NO: 52859 - RNA, 14 nt, Homo sapiens
ugcgcgccgcgcuc

SEQ ID NO: 52860 - RNA, 17 nt, Homo sapiens
ugcgcgccgcgcuccuc

SEQ ID NO: 52861 - RNA, 20 nt, Homo sapiens
ugcgcgccgcgcuccucgga

SEQ ID NO: 52862 - RNA, 21 nt, Homo sapiens
ugcgcgccgcgcuccucggac

SEQ ID NO: 52863 - RNA, 19 nt, Homo sapiens
ugcgcucggccugcucgcc

SEQ ID NO: 52864 - RNA, 20 nt, Homo sapiens
ugcgcucggccugcucgccc

SEQ ID NO: 52865 - RNA, 12 nt, Homo sapiens
ugcggccugguc

SEQ ID NO: 52866 - RNA, 17 nt, Homo sapiens
ugcuacaaaaacacagc

SEQ ID NO: 52867 - RNA, 20 nt, Homo sapiens
ugcuacaaauacucuuagga

SEQ ID NO: 52868 - RNA, 12 nt, Homo sapiens
ugcuacacacug

SEQ ID NO: 52869 - RNA, 15 nt, Homo sapiens
ugcuaguaauuggaa

SEQ ID NO: 52870 - RNA, 14 nt, Homo sapiens
ugcuaucaauccaa

SEQ ID NO: 52871 - RNA, 12 nt, Homo sapiens
ugcuaucgccau

SEQ ID NO: 52872 - RNA, 19 nt, Homo sapiens
ugcuauugggguugggggg

SEQ ID NO: 52873 - RNA, 20 nt, Homo sapiens
ugcuauugggguuggggggg

SEQ ID NO: 52874 - RNA, 14 nt, Homo sapiens
ugcuauuugcuguu

SEQ ID NO: 52875 - RNA, 16 nt, Homo sapiens
ugcuauuugcuguuau

SEQ ID NO: 52876 - RNA, 22 nt, Homo sapiens
ugcucauggaauuggagcucgu

SEQ ID NO: 52877 - RNA, 15 nt, Homo sapiens
ugcucgcccacuucc

SEQ ID NO: 52878 - RNA, 17 nt, Homo sapiens
ugcucgcccacuuccuc

SEQ ID NO: 52879 - RNA, 22 nt, Homo sapiens
ugcucgcccacuuccucccggc

SEQ ID NO: 52880 - RNA, 22 nt, Homo sapiens
ugcugaaccguuugugauugcc

SEQ ID NO: 52881 - RNA, 14 nt, Homo sapiens
ugcugcccuucccc

SEQ ID NO: 52882 - RNA, 11 nt, Homo sapiens
ugcugccgugg

SEQ ID NO: 52883 - RNA, 14 nt, Homo sapiens
ugcugccgugggcc

SEQ ID NO: 52884 - RNA, 14 nt, Homo sapiens
ugcugccugccugg

SEQ ID NO: 52885 - RNA, 15 nt, Homo sapiens
ugcugccugccugga

SEQ ID NO: 52886 - RNA, 13 nt, Homo sapiens
ugcugcugccugc

SEQ ID NO: 52887 - RNA, 14 nt, Homo sapiens
ugcugcugccugcc

SEQ ID NO: 52888 - RNA, 23 nt, Homo sapiens
ugcuggauguggagggggcgcgu

SEQ ID NO: 52889 - RNA, 17 nt, Homo sapiens
ugcuggauucaagugau

SEQ ID NO: 52890 - RNA, 22 nt, Homo sapiens
ugcuggauucaagugauccgcc

SEQ ID NO: 52891 - RNA, 23 nt, Homo sapiens
ugcuggauucaagugauccgccc

SEQ ID NO: 52892 - RNA, 15 nt, Homo sapiens
ugcuggccaggcugg

SEQ ID NO: 52893 - RNA, 19 nt, Homo sapiens
ugcuggcuuaaaauguaau

SEQ ID NO: 52894 - RNA, 23 nt, Homo sapiens
ugcuggcuugccucuugcaauuc

SEQ ID NO: 52895 - RNA, 21 nt, Homo sapiens
ugcugggaauuacaggcguga

SEQ ID NO: 52896 - RNA, 12 nt, Homo sapiens
ugcugguggcgc

SEQ ID NO: 52897 - RNA, 17 nt, Homo sapiens
ugcugguggcgcuggcu

SEQ ID NO: 52898 - RNA, 21 nt, Homo sapiens
ugcugguggcgcuggcugcgc

SEQ ID NO: 52899 - RNA, 22 nt, Homo sapiens
ugcugguggcgcuggcugcgcu

SEQ ID NO: 52900 - RNA, 14 nt, Homo sapiens
ugcuguaugucucg

SEQ ID NO: 52901 - RNA, 21 nt, Homo sapiens
ugcuguuauuuuaucugcuau

SEQ ID NO: 52902 - RNA, 19 nt, Homo sapiens
ugcuguuuccuagcgcagc

SEQ ID NO: 52903 - RNA, 22 nt, Homo sapiens
ugcuguuuccuagcgcagccau

SEQ ID NO: 52904 - RNA, 13 nt, Homo sapiens
ugcuuguacauaa

SEQ ID NO: 52905 - RNA, 16 nt, Homo sapiens
ugcuuguacauaaugc

SEQ ID NO: 52906 - RNA, 19 nt, Homo sapiens
ugcuuguuagcaaaaugga

SEQ ID NO: 52907 - RNA, 22 nt, Homo sapiens
ugcuuuaauaucaucaguauug

SEQ ID NO: 52908 - RNA, 15 nt, Homo sapiens
ugcuuucuaucuaau

SEQ ID NO: 52909 - RNA, 16 nt, Homo sapiens
uggaaaaaaaggaaga

SEQ ID NO: 52910 - RNA, 15 nt, Homo sapiens
uggaaaaugugcaau

SEQ ID NO: 52911 - RNA, 16 nt, Homo sapiens
uggaaauacacuguua

SEQ ID NO: 52912 - RNA, 16 nt, Homo sapiens
uggaacucaaggaaau

SEQ ID NO: 52913 - RNA, 19 nt, Homo sapiens
uggaagccucuauugccau

SEQ ID NO: 52914 - RNA, 17 nt, Homo sapiens
uggaaguaaauguuguu

SEQ ID NO: 52915 - RNA, 19 nt, Homo sapiens
uggaaguaaauguuguuuu

SEQ ID NO: 52916 - RNA, 14 nt, Homo sapiens
uggaauuggagcuc

SEQ ID NO: 52917 - RNA, 17 nt, Homo sapiens
uggaauuggagcucgug

SEQ ID NO: 52918 - RNA, 18 nt, Homo sapiens
uggaauuggagcucgugg

SEQ ID NO: 52919 - RNA, 22 nt, Homo sapiens
uggacaaaauggaauacucuua

SEQ ID NO: 52920 - RNA, 21 nt, Homo sapiens
uggacaguuuucugcuuuaau

SEQ ID NO: 52921 - RNA, 19 nt, Homo sapiens
uggacaugggccccagaua

SEQ ID NO: 52922 - RNA, 23 nt, Homo sapiens
uggaccauaaccccggaagccaa

SEQ ID NO: 52923 - RNA, 16 nt, Homo sapiens
uggacuuaaaaucuaa

SEQ ID NO: 52924 - RNA, 23 nt, Homo sapiens
uggacuuuccagagaccaguauu

SEQ ID NO: 52925 - RNA, 18 nt, Homo sapiens
uggagaaaggacccucaa

SEQ ID NO: 52926 - RNA, 14 nt, Homo sapiens
uggagacaccacca

SEQ ID NO: 52927 - RNA, 15 nt, Homo sapiens
uggagacaccaccac

SEQ ID NO: 52928 - RNA, 16 nt, Homo sapiens
uggagacaccaccacc

SEQ ID NO: 52929 - RNA, 13 nt, Homo sapiens
uggagcuagaauu

SEQ ID NO: 52930 - RNA, 19 nt, Homo sapiens
uggagcugccucucucauc

SEQ ID NO: 52931 - RNA, 19 nt, Homo sapiens
uggagcuugaaauaguguc

SEQ ID NO: 52932 - RNA, 16 nt, Homo sapiens
uggagugcaguggcgc

SEQ ID NO: 52933 - RNA, 17 nt, Homo sapiens
uggagugcaguggcgca

SEQ ID NO: 52934 - RNA, 19 nt, Homo sapiens
uggauaugacacaucucug

SEQ ID NO: 52935 - RNA, 15 nt, Homo sapiens
uggauggcugccuca

SEQ ID NO: 52936 - RNA, 20 nt, Homo sapiens
uggauuaaacuuaaucuaaa

SEQ ID NO: 52937 - RNA, 16 nt, Homo sapiens
uggauuccucacuuug

SEQ ID NO: 52938 - RNA, 18 nt, Homo sapiens
uggauuccucacuuugaa

SEQ ID NO: 52939 - RNA, 16 nt, Homo sapiens
uggauuuaacagaaau

SEQ ID NO: 52940 - RNA, 13 nt, Homo sapiens
uggcaauagucaa

SEQ ID NO: 52941 - RNA, 13 nt, Homo sapiens
uggcacugcauac

SEQ ID NO: 52942 - RNA, 17 nt, Homo sapiens
uggcacuuauaaccaaa

SEQ ID NO: 52943 - RNA, 15 nt, Homo sapiens
uggcaggcaucgcca

SEQ ID NO: 52944 - RNA, 13 nt, Homo sapiens
uggcaguuuucca

SEQ ID NO: 52945 - RNA, 22 nt, Homo sapiens
uggcauguaugacgugacuggc

SEQ ID NO: 52946 - RNA, 15 nt, Homo sapiens
uggcauuuucacuuu

SEQ ID NO: 52947 - RNA, 13 nt, Homo sapiens
uggccaaugagau

SEQ ID NO: 52948 - RNA, 21 nt, Homo sapiens
uggccaaugagaucauuguga

SEQ ID NO: 52949 - RNA, 14 nt, Homo sapiens
uggccagaagucaa

SEQ ID NO: 52950 - RNA, 19 nt, Homo sapiens
uggccagaagucaaggcuu

SEQ ID NO: 52951 - RNA, 22 nt, Homo sapiens
uggccaggcuggucucgaacug

SEQ ID NO: 52952 - RNA, 19 nt, Homo sapiens
uggccagugagaucaaugu

SEQ ID NO: 52953 - RNA, 20 nt, Homo sapiens
uggccagugagaucaaugug

SEQ ID NO: 52954 - RNA, 20 nt, Homo sapiens
uggcccaggaguuuggccag

SEQ ID NO: 52955 - RNA, 15 nt, Homo sapiens
uggccccugccaccu

SEQ ID NO: 52956 - RNA, 11 nt, Homo sapiens
uggccuuucau

SEQ ID NO: 52957 - RNA, 12 nt, Homo sapiens
uggccuuucaua

SEQ ID NO: 52958 - RNA, 21 nt, Homo sapiens
uggcgacaguuuuccuucuca

SEQ ID NO: 52959 - RNA, 15 nt, Homo sapiens
uggcgcgcgccacca

SEQ ID NO: 52960 - RNA, 19 nt, Homo sapiens
uggcgcgcgccaccacgcc

SEQ ID NO: 52961 - RNA, 12 nt, Homo sapiens
uggcgcuggcug

SEQ ID NO: 52962 - RNA, 13 nt, Homo sapiens
uggcgcuggcugc

SEQ ID NO: 52963 - RNA, 14 nt, Homo sapiens
uggcgcuggcugcg

SEQ ID NO: 52964 - RNA, 18 nt, Homo sapiens
uggcgcuggcugcgcucg

SEQ ID NO: 52965 - RNA, 19 nt, Homo sapiens
uggcgcuggcugcgcucgg

SEQ ID NO: 52966 - RNA, 23 nt, Homo sapiens
uggcuaguaucaaaagaaagaaa

SEQ ID NO: 52967 - RNA, 17 nt, Homo sapiens
uggcugcgcucggccug

SEQ ID NO: 52968 - RNA, 18 nt, Homo sapiens
uggcugcgcucggccugc

SEQ ID NO: 52969 - RNA, 23 nt, Homo sapiens
uggcugcgcucggccugcucgcc

SEQ ID NO: 52970 - RNA, 18 nt, Homo sapiens
uggcugcugguggcgcug

SEQ ID NO: 52971 - RNA, 22 nt, Homo sapiens
uggcugcugguggcgcuggcug

SEQ ID NO: 52972 - RNA, 13 nt, Homo sapiens
uggcugggagugg

SEQ ID NO: 52973 - RNA, 16 nt, Homo sapiens
uggcugggaguggcau

SEQ ID NO: 52974 - RNA, 17 nt, Homo sapiens
uggcugggaguggcaug

SEQ ID NO: 52975 - RNA, 19 nt, Homo sapiens
uggcuugccucuugcaauu

SEQ ID NO: 52976 - RNA, 14 nt, Homo sapiens
uggcuuuugugcau

SEQ ID NO: 52977 - RNA, 15 nt, Homo sapiens
uggcuuuugugcauu

SEQ ID NO: 52978 - RNA, 20 nt, Homo sapiens
ugggaauuacaggcgugagc

SEQ ID NO: 52979 - RNA, 17 nt, Homo sapiens
ugggaauuuucuuccaa

SEQ ID NO: 52980 - RNA, 15 nt, Homo sapiens
ugggacagucaccuc

SEQ ID NO: 52981 - RNA, 23 nt, Homo sapiens
ugggacaguuccugagaccagcc

SEQ ID NO: 52982 - RNA, 24 nt, Homo sapiens
ugggacaguuccugagaccagcca

SEQ ID NO: 52983 - RNA, 19 nt, Homo sapiens
ugggagaaucacuugaacc

SEQ ID NO: 52984 - RNA, 17 nt, Homo sapiens
ugggaguggcauguaug

SEQ ID NO: 52985 - RNA, 23 nt, Homo sapiens
ugggauacuauuuaauuauuuca

SEQ ID NO: 52986 - RNA, 21 nt, Homo sapiens
ugggauagcugacccagcccc

SEQ ID NO: 52987 - RNA, 22 nt, Homo sapiens
ugggcaagggaccugcuucuau

SEQ ID NO: 52988 - RNA, 18 nt, Homo sapiens
ugggcagacucuggucaa

SEQ ID NO: 52989 - RNA, 17 nt, Homo sapiens
ugggccauagucauucu

SEQ ID NO: 52990 - RNA, 19 nt, Homo sapiens
ugggccccagauaccauga

SEQ ID NO: 52991 - RNA, 18 nt, Homo sapiens
ugggccugagaccaaggc

SEQ ID NO: 52992 - RNA, 19 nt, Homo sapiens
ugggccugagaccaaggcc

SEQ ID NO: 52993 - RNA, 17 nt, Homo sapiens
ugggccuggauggcugc

SEQ ID NO: 52994 - RNA, 16 nt, Homo sapiens
uggggcagugcuuggc

SEQ ID NO: 52995 - RNA, 17 nt, Homo sapiens
uggggcagugcuuggcc

SEQ ID NO: 52996 - RNA, 23 nt, Homo sapiens
uggggcagugcuuggcccaggag

SEQ ID NO: 52997 - RNA, 16 nt, Homo sapiens
uggggcugaugcaguu

SEQ ID NO: 52998 - RNA, 17 nt, Homo sapiens
uggggcugaugcaguug

SEQ ID NO: 52999 - RNA, 23 nt, Homo sapiens
uggggguaauaagagcaguagca

SEQ ID NO: 53000 - RNA, 17 nt, Homo sapiens
ugggguugggggggagg

SEQ ID NO: 53001 - RNA, 13 nt, Homo sapiens
ugggucgccggca

SEQ ID NO: 53002 - RNA, 14 nt, Homo sapiens
ugggucgccggcau

SEQ ID NO: 53003 - RNA, 16 nt, Homo sapiens
ugggucgccggcaucu

SEQ ID NO: 53004 - RNA, 18 nt, Homo sapiens
ugggucgccggcaucuuc

SEQ ID NO: 53005 - RNA, 18 nt, Homo sapiens
ugggucucaguguccuca

SEQ ID NO: 53006 - RNA, 11 nt, Homo sapiens
uggguggggca

SEQ ID NO: 53007 - RNA, 16 nt, Homo sapiens
uggguggggcagugcu

SEQ ID NO: 53008 - RNA, 16 nt, Homo sapiens
uggguucaagcgauuc

SEQ ID NO: 53009 - RNA, 17 nt, Homo sapiens
uggguuucacaagugaa

SEQ ID NO: 53010 - RNA, 16 nt, Homo sapiens
uggucaacauggugaa

SEQ ID NO: 53011 - RNA, 23 nt, Homo sapiens
uggucucagugucaaugcagccc

SEQ ID NO: 53012 - RNA, 20 nt, Homo sapiens
uggucucgaacugcuggauu

SEQ ID NO: 53013 - RNA, 14 nt, Homo sapiens
uggugccucaguuu

SEQ ID NO: 53014 - RNA, 18 nt, Homo sapiens
uggugcuuccaaauauug

SEQ ID NO: 53015 - RNA, 16 nt, Homo sapiens
uggugguuucagaaau

SEQ ID NO: 53016 - RNA, 12 nt, Homo sapiens
uggugugaacua

SEQ ID NO: 53017 - RNA, 20 nt, Homo sapiens
ugguucuucuuggucucagu

SEQ ID NO: 53018 - RNA, 13 nt, Homo sapiens
ugguuuguaaauu

SEQ ID NO: 53019 - RNA, 18 nt, Homo sapiens
ugguuuguaaauuaacuu

SEQ ID NO: 53020 - RNA, 18 nt, Homo sapiens
ugguuuuucaguuuucag

SEQ ID NO: 53021 - RNA, 16 nt, Homo sapiens
uguaaaauggagacac

SEQ ID NO: 53022 - RNA, 21 nt, Homo sapiens
uguaaacuaguuacuaaacau

SEQ ID NO: 53023 - RNA, 13 nt, Homo sapiens
uguaaaugugcuu

SEQ ID NO: 53024 - RNA, 15 nt, Homo sapiens
uguaacuguaaagau

SEQ ID NO: 53025 - RNA, 17 nt, Homo sapiens
uguaaguuuaugcauac

SEQ ID NO: 53026 - RNA, 22 nt, Homo sapiens
uguaauagaaauaaaccuauga

SEQ ID NO: 53027 - RNA, 19 nt, Homo sapiens
uguaaucacagcuacuugg

SEQ ID NO: 53028 - RNA, 19 nt, Homo sapiens
uguaaucccagcacuuugg

SEQ ID NO: 53029 - RNA, 18 nt, Homo sapiens
uguaaugaaaaugaauau

SEQ ID NO: 53030 - RNA, 21 nt, Homo sapiens
uguaaugaaaaugaauaucua

SEQ ID NO: 53031 - RNA, 14 nt, Homo sapiens
uguaauugcuuguu

SEQ ID NO: 53032 - RNA, 20 nt, Homo sapiens
uguaauuugugauacaaugc

SEQ ID NO: 53033 - RNA, 16 nt, Homo sapiens
uguacaccaauauuca

SEQ ID NO: 53034 - RNA, 16 nt, Homo sapiens
uguacagucuuguauu

SEQ ID NO: 53035 - RNA, 17 nt, Homo sapiens
uguacauuuccaaauuc

SEQ ID NO: 53036 - RNA, 19 nt, Homo sapiens
uguacauuuccaaauucac

SEQ ID NO: 53037 - RNA, 20 nt, Homo sapiens
uguacgcgagcgcgcgcgcc

SEQ ID NO: 53038 - RNA, 21 nt, Homo sapiens
uguacgcgagcgcgcgcgccc

SEQ ID NO: 53039 - RNA, 23 nt, Homo sapiens
uguacgcgagcgcgcgcgcccuc

SEQ ID NO: 53040 - RNA, 18 nt, Homo sapiens
uguacucugaaaguuuug

SEQ ID NO: 53041 - RNA, 13 nt, Homo sapiens
uguacuuuuucca

SEQ ID NO: 53042 - RNA, 17 nt, Homo sapiens
uguagauaaacucagaa

SEQ ID NO: 53043 - RNA, 17 nt, Homo sapiens
uguagauaaagcacugu

SEQ ID NO: 53044 - RNA, 17 nt, Homo sapiens
uguagccacuucacuuu

SEQ ID NO: 53045 - RNA, 20 nt, Homo sapiens
uguagcguacaucaaugaua

SEQ ID NO: 53046 - RNA, 17 nt, Homo sapiens
uguauaaaauaauuuuu

SEQ ID NO: 53047 - RNA, 14 nt, Homo sapiens
uguauagugcaugu

SEQ ID NO: 53048 - RNA, 12 nt, Homo sapiens
uguaucaugaca

SEQ ID NO: 53049 - RNA, 14 nt, Homo sapiens
uguaugugcacauc

SEQ ID NO: 53050 - RNA, 15 nt, Homo sapiens
uguauuccuuuuucu

SEQ ID NO: 53051 - RNA, 23 nt, Homo sapiens
uguauuuuauuacaucuuucaca

SEQ ID NO: 53052 - RNA, 21 nt, Homo sapiens
ugucaagaugaugaugaucuu

SEQ ID NO: 53053 - RNA, 20 nt, Homo sapiens
ugucaauaaaauccauacau

SEQ ID NO: 53054 - RNA, 12 nt, Homo sapiens
ugucaaugcagc

SEQ ID NO: 53055 - RNA, 15 nt, Homo sapiens
ugucaaugcagcccc

SEQ ID NO: 53056 - RNA, 17 nt, Homo sapiens
ugucagccacugugaua

SEQ ID NO: 53057 - RNA, 13 nt, Homo sapiens
ugucucaguccau

SEQ ID NO: 53058 - RNA, 14 nt, Homo sapiens
ugucucaguccaug

SEQ ID NO: 53059 - RNA, 23 nt, Homo sapiens
ugucucgugguaggacuguagaa

SEQ ID NO: 53060 - RNA, 19 nt, Homo sapiens
ugucuggcacuugggacaa

SEQ ID NO: 53061 - RNA, 22 nt, Homo sapiens
ugucuuacagagaaaagacaua

SEQ ID NO: 53062 - RNA, 23 nt, Homo sapiens
ugucuuacagagaaaagacauaa

SEQ ID NO: 53063 - RNA, 22 nt, Homo sapiens
ugucuugggaauuuucuuccaa

SEQ ID NO: 53064 - RNA, 19 nt, Homo sapiens
ugugaacuaaacuuucaca

SEQ ID NO: 53065 - RNA, 13 nt, Homo sapiens
ugugaagcaaaau

SEQ ID NO: 53066 - RNA, 20 nt, Homo sapiens
ugugaaggcaggggaaugua

SEQ ID NO: 53067 - RNA, 11 nt, Homo sapiens
ugugacucauu

SEQ ID NO: 53068 - RNA, 13 nt, Homo sapiens
ugugacuuuccua

SEQ ID NO: 53069 - RNA, 12 nt, Homo sapiens
ugugauacaaug

SEQ ID NO: 53070 - RNA, 17 nt, Homo sapiens
ugugauuacccucuggg

SEQ ID NO: 53071 - RNA, 20 nt, Homo sapiens
ugugauugacgggacuguug

SEQ ID NO: 53072 - RNA, 12 nt, Homo sapiens
ugugauugccau

SEQ ID NO: 53073 - RNA, 23 nt, Homo sapiens
ugugcauuaucuagauacuguau

SEQ ID NO: 53074 - RNA, 15 nt, Homo sapiens
ugugccuucauuuuu

SEQ ID NO: 53075 - RNA, 15 nt, Homo sapiens
uguggcaaaucucua

SEQ ID NO: 53076 - RNA, 17 nt, Homo sapiens
uguggcauuuucacuuu

SEQ ID NO: 53077 - RNA, 23 nt, Homo sapiens
uguggcuguaucuuguuuuucca

SEQ ID NO: 53078 - RNA, 19 nt, Homo sapiens
ugugggcaauguucccccu

SEQ ID NO: 53079 - RNA, 14 nt, Homo sapiens
uguggucacaggaa

SEQ ID NO: 53080 - RNA, 21 nt, Homo sapiens
ugugguccgaagucuuccaua

SEQ ID NO: 53081 - RNA, 19 nt, Homo sapiens
uguguggcauuuucacuuu

SEQ ID NO: 53082 - RNA, 15 nt, Homo sapiens
uguguucaguacaau

SEQ ID NO: 53083 - RNA, 23 nt, Homo sapiens
uguguuugauauccaaagcugaa

SEQ ID NO: 53084 - RNA, 14 nt, Homo sapiens
uguguuuuucacau

SEQ ID NO: 53085 - RNA, 20 nt, Homo sapiens
uguuaaaagaugaaaauauu

SEQ ID NO: 53086 - RNA, 21 nt, Homo sapiens
uguuaaaagaugaaaauauuu

SEQ ID NO: 53087 - RNA, 20 nt, Homo sapiens
uguuaaguaucagcuacaau

SEQ ID NO: 53088 - RNA, 14 nt, Homo sapiens
uguuaaucuuucaa

SEQ ID NO: 53089 - RNA, 16 nt, Homo sapiens
uguuacauuuuuaagu

SEQ ID NO: 53090 - RNA, 16 nt, Homo sapiens
uguuacuaaguuuuua

SEQ ID NO: 53091 - RNA, 18 nt, Homo sapiens
uguuacugccuaucagca

SEQ ID NO: 53092 - RNA, 14 nt, Homo sapiens
uguuagagcagaga

SEQ ID NO: 53093 - RNA, 22 nt, Homo sapiens
uguuagcaaaauggauaugaca

SEQ ID NO: 53094 - RNA, 18 nt, Homo sapiens
uguuaucuucacuuuuau

SEQ ID NO: 53095 - RNA, 16 nt, Homo sapiens
uguuauuuauugaaau

SEQ ID NO: 53096 - RNA, 18 nt, Homo sapiens
uguucacuuauugacuau

SEQ ID NO: 53097 - RNA, 15 nt, Homo sapiens
uguuccucgccacgc

SEQ ID NO: 53098 - RNA, 13 nt, Homo sapiens
uguucuauaacaa

SEQ ID NO: 53099 - RNA, 16 nt, Homo sapiens
uguugacaugggacau

SEQ ID NO: 53100 - RNA, 13 nt, Homo sapiens
uguugauagcaag

SEQ ID NO: 53101 - RNA, 17 nt, Homo sapiens
uguugcuaucaauccaa

SEQ ID NO: 53102 - RNA, 17 nt, Homo sapiens
uguuggaaaaugugcaa

SEQ ID NO: 53103 - RNA, 18 nt, Homo sapiens
uguuggaaaaugugcaau

SEQ ID NO: 53104 - RNA, 19 nt, Homo sapiens
uguuggaaaaugugcaaua

SEQ ID NO: 53105 - RNA, 17 nt, Homo sapiens
uguugguacuagauacu

SEQ ID NO: 53106 - RNA, 20 nt, Homo sapiens
uguuguuuuaggaauacaua

SEQ ID NO: 53107 - RNA, 21 nt, Homo sapiens
uguuguuuuaggaauacauaa

SEQ ID NO: 53108 - RNA, 23 nt, Homo sapiens
uguuuacaaaccucaagccagcc

SEQ ID NO: 53109 - RNA, 16 nt, Homo sapiens
uguuuagaaacacaac

SEQ ID NO: 53110 - RNA, 13 nt, Homo sapiens
uguuucauaagaa

SEQ ID NO: 53111 - RNA, 18 nt, Homo sapiens
uguuuccauagggugaca

SEQ ID NO: 53112 - RNA, 19 nt, Homo sapiens
uguuuccauagggugacac

SEQ ID NO: 53113 - RNA, 12 nt, Homo sapiens
uguuuccaucaa

SEQ ID NO: 53114 - RNA, 18 nt, Homo sapiens
uguuuccuagcgcagcca

SEQ ID NO: 53115 - RNA, 19 nt, Homo sapiens
uguuugaagcacagugauc

SEQ ID NO: 53116 - RNA, 12 nt, Homo sapiens
uguuugugauug

SEQ ID NO: 53117 - RNA, 14 nt, Homo sapiens
uguuuuaaggaugc

SEQ ID NO: 53118 - RNA, 16 nt, Homo sapiens
uguuuuaggaauacau

SEQ ID NO: 53119 - RNA, 14 nt, Homo sapiens
uguuuucauuaucu

SEQ ID NO: 53120 - RNA, 19 nt, Homo sapiens
uuaaaaaaaaaccugagcc

SEQ ID NO: 53121 - RNA, 20 nt, Homo sapiens
uuaaaaaaaaaccugagccc

SEQ ID NO: 53122 - RNA, 19 nt, Homo sapiens
uuaaaaaaaaauacugaug

SEQ ID NO: 53123 - RNA, 16 nt, Homo sapiens
uuaaaagaaugauuau

SEQ ID NO: 53124 - RNA, 23 nt, Homo sapiens
uuaaaauauuuuuaugugcaaua

SEQ ID NO: 53125 - RNA, 21 nt, Homo sapiens
uuaaaaucacaaacucaucca

SEQ ID NO: 53126 - RNA, 20 nt, Homo sapiens
uuaaaaucuaauucaaacua

SEQ ID NO: 53127 - RNA, 13 nt, Homo sapiens
uuaaaauguaauu

SEQ ID NO: 53128 - RNA, 14 nt, Homo sapiens
uuaaacuuacuuag

SEQ ID NO: 53129 - RNA, 15 nt, Homo sapiens
uuaaagaauuuucaa

SEQ ID NO: 53130 - RNA, 16 nt, Homo sapiens
uuaaaguucuagugac

SEQ ID NO: 53131 - RNA, 23 nt, Homo sapiens
uuaaauaaaauuuuuauguaauu

SEQ ID NO: 53132 - RNA, 20 nt, Homo sapiens
uuaaauaaugugaaacugga

SEQ ID NO: 53133 - RNA, 22 nt, Homo sapiens
uuaaauagcuuuuuucucugau

SEQ ID NO: 53134 - RNA, 17 nt, Homo sapiens
uuaaauggagaaaggac

SEQ ID NO: 53135 - RNA, 16 nt, Homo sapiens
uuaacaaaauuugaau

SEQ ID NO: 53136 - RNA, 15 nt, Homo sapiens
uuaacacagugucug

SEQ ID NO: 53137 - RNA, 14 nt, Homo sapiens
uuaaccucuaaauu

SEQ ID NO: 53138 - RNA, 22 nt, Homo sapiens
uuaagagagucuauuuacggaa

SEQ ID NO: 53139 - RNA, 12 nt, Homo sapiens
uuaagccuuaaa

SEQ ID NO: 53140 - RNA, 19 nt, Homo sapiens
uuaaggaugcuuguacaua

SEQ ID NO: 53141 - RNA, 13 nt, Homo sapiens
uuaaguaucugac

SEQ ID NO: 53142 - RNA, 14 nt, Homo sapiens
uuaaguaucugaca

SEQ ID NO: 53143 - RNA, 19 nt, Homo sapiens
uuaaguuuuuuuuuaaaaa

SEQ ID NO: 53144 - RNA, 19 nt, Homo sapiens
uuaauaucaucaguauuga

SEQ ID NO: 53145 - RNA, 15 nt, Homo sapiens
uuaauauuucugagg

SEQ ID NO: 53146 - RNA, 11 nt, Homo sapiens
uuaaucaccaa

SEQ ID NO: 53147 - RNA, 11 nt, Homo sapiens
uuaauguggaa

SEQ ID NO: 53148 - RNA, 12 nt, Homo sapiens
uuaauguggaaa

SEQ ID NO: 53149 - RNA, 17 nt, Homo sapiens
uuacaaaccucaagcca

SEQ ID NO: 53150 - RNA, 14 nt, Homo sapiens
uuacagagacagaa

SEQ ID NO: 53151 - RNA, 16 nt, Homo sapiens
uuacaggaacagaaga

SEQ ID NO: 53152 - RNA, 18 nt, Homo sapiens
uuacauuuguauaaaaua

SEQ ID NO: 53153 - RNA, 20 nt, Homo sapiens
uuacccccugggagccccaa

SEQ ID NO: 53154 - RNA, 16 nt, Homo sapiens
uuaccuuuguucccaa

SEQ ID NO: 53155 - RNA, 12 nt, Homo sapiens
uuacgugcaaua

SEQ ID NO: 53156 - RNA, 14 nt, Homo sapiens
uuacuaaacaugua

SEQ ID NO: 53157 - RNA, 21 nt, Homo sapiens
uuacuauuuauugcugaauga

SEQ ID NO: 53158 - RNA, 22 nt, Homo sapiens
uuacuauuuauugcugaaugac

SEQ ID NO: 53159 - RNA, 20 nt, Homo sapiens
uuacugagcuucucugugaa

SEQ ID NO: 53160 - RNA, 18 nt, Homo sapiens
uuacuguaagaaaauauc

SEQ ID NO: 53161 - RNA, 13 nt, Homo sapiens
uuacuucuucuca

SEQ ID NO: 53162 - RNA, 13 nt, Homo sapiens
uuagaaacacaac

SEQ ID NO: 53163 - RNA, 15 nt, Homo sapiens
uuagacccucaugcu

SEQ ID NO: 53164 - RNA, 23 nt, Homo sapiens
uuagagaauuuccuuacucuuga

SEQ ID NO: 53165 - RNA, 23 nt, Homo sapiens
uuagagcagagagguuucgauau

SEQ ID NO: 53166 - RNA, 15 nt, Homo sapiens
uuagaugaaugucag

SEQ ID NO: 53167 - RNA, 21 nt, Homo sapiens
uuagaugcaguucugaagaag

SEQ ID NO: 53168 - RNA, 16 nt, Homo sapiens
uuagcccaucuuucaa

SEQ ID NO: 53169 - RNA, 12 nt, Homo sapiens
uuagccgggcgu

SEQ ID NO: 53170 - RNA, 21 nt, Homo sapiens
uuagccgggcgugguggugag

SEQ ID NO: 53171 - RNA, 22 nt, Homo sapiens
uuagccgggcgugguggugagu

SEQ ID NO: 53172 - RNA, 18 nt, Homo sapiens
uuaggaguaccauaauuc

SEQ ID NO: 53173 - RNA, 14 nt, Homo sapiens
uuagggguagcauu

SEQ ID NO: 53174 - RNA, 16 nt, Homo sapiens
uuaguaugugcauuua

SEQ ID NO: 53175 - RNA, 22 nt, Homo sapiens
uuaguucaauccugauucauau

SEQ ID NO: 53176 - RNA, 19 nt, Homo sapiens
uuaguucaaucuggauuca

SEQ ID NO: 53177 - RNA, 15 nt, Homo sapiens
uuaguucuucaaaga

SEQ ID NO: 53178 - RNA, 20 nt, Homo sapiens
uuauaagaaauaggaaauau

SEQ ID NO: 53179 - RNA, 21 nt, Homo sapiens
uuauaagugaagugauacuau

SEQ ID NO: 53180 - RNA, 12 nt, Homo sapiens
uuauaaucuuuu

SEQ ID NO: 53181 - RNA, 16 nt, Homo sapiens
uuauagccagguaccu

SEQ ID NO: 53182 - RNA, 16 nt, Homo sapiens
uuauaguaaugugacu

SEQ ID NO: 53183 - RNA, 23 nt, Homo sapiens
uuauauuuccaagaaauauuccu

SEQ ID NO: 53184 - RNA, 15 nt, Homo sapiens
uuauauuugaaauau

SEQ ID NO: 53185 - RNA, 19 nt, Homo sapiens
uuaucaugcaaaugcugua

SEQ ID NO: 53186 - RNA, 17 nt, Homo sapiens
uuauccuuguuaaguau

SEQ ID NO: 53187 - RNA, 16 nt, Homo sapiens
uuaucucaaaacugca

SEQ ID NO: 53188 - RNA, 12 nt, Homo sapiens
uuaucugcuaug

SEQ ID NO: 53189 - RNA, 13 nt, Homo sapiens
uuaucuucacuuu

SEQ ID NO: 53190 - RNA, 16 nt, Homo sapiens
uuaugaaacauuacag

SEQ ID NO: 53191 - RNA, 16 nt, Homo sapiens
uuaugacuucauuaau

SEQ ID NO: 53192 - RNA, 16 nt, Homo sapiens
uuaugcauaaagucag

SEQ ID NO: 53193 - RNA, 15 nt, Homo sapiens
uuauguguaaaauaa

SEQ ID NO: 53194 - RNA, 15 nt, Homo sapiens
uuauuaccucugaua

SEQ ID NO: 53195 - RNA, 21 nt, Homo sapiens
uuauuauuuuagagcaucuca

SEQ ID NO: 53196 - RNA, 16 nt, Homo sapiens
uuauugauguuuucau

SEQ ID NO: 53197 - RNA, 12 nt, Homo sapiens
uuauuguagcau

SEQ ID NO: 53198 - RNA, 19 nt, Homo sapiens
uuauuuagggaacugcuug

SEQ ID NO: 53199 - RNA, 16 nt, Homo sapiens
uuauuuauuuauucau

SEQ ID NO: 53200 - RNA, 12 nt, Homo sapiens
uuauuucacuuu

SEQ ID NO: 53201 - RNA, 15 nt, Homo sapiens
uuauuuuaucugcua

SEQ ID NO: 53202 - RNA, 16 nt, Homo sapiens
uuauuuuuacaguucu

SEQ ID NO: 53203 - RNA, 17 nt, Homo sapiens
uuauuuuuuuacuuccu

SEQ ID NO: 53204 - RNA, 23 nt, Homo sapiens
uucaaaaauuauauuuugaacaa

SEQ ID NO: 53205 - RNA, 19 nt, Homo sapiens
uucaaaaucaaauuccaga

SEQ ID NO: 53206 - RNA, 21 nt, Homo sapiens
uucaaaaucaaauuccagaau

SEQ ID NO: 53207 - RNA, 17 nt, Homo sapiens
uucaaaauuggacuuaa

SEQ ID NO: 53208 - RNA, 19 nt, Homo sapiens
uucaaacagucucaggaaa

SEQ ID NO: 53209 - RNA, 12 nt, Homo sapiens
uucaaacuuuac

SEQ ID NO: 53210 - RNA, 14 nt, Homo sapiens
uucaaacuuuacua

SEQ ID NO: 53211 - RNA, 22 nt, Homo sapiens
uucacaaagaacaggaaaauaa

SEQ ID NO: 53212 - RNA, 16 nt, Homo sapiens
uucacaagacccaaaa

SEQ ID NO: 53213 - RNA, 13 nt, Homo sapiens
uucacagccagac

SEQ ID NO: 53214 - RNA, 16 nt, Homo sapiens
uucacaggggacagga

SEQ ID NO: 53215 - RNA, 13 nt, Homo sapiens
uucacauuggaaa

SEQ ID NO: 53216 - RNA, 14 nt, Homo sapiens
uucacauuggaaac

SEQ ID NO: 53217 - RNA, 15 nt, Homo sapiens
uucacauuggaaaca

SEQ ID NO: 53218 - RNA, 17 nt, Homo sapiens
uucacuccacuuggaca

SEQ ID NO: 53219 - RNA, 14 nt, Homo sapiens
uucacuuauugacu

SEQ ID NO: 53220 - RNA, 20 nt, Homo sapiens
uucacuuuuauaagaaauag

SEQ ID NO: 53221 - RNA, 17 nt, Homo sapiens
uucagauaugauucaaa

SEQ ID NO: 53222 - RNA, 18 nt, Homo sapiens
uucaggaugcccacggcu

SEQ ID NO: 53223 - RNA, 19 nt, Homo sapiens
uucaggaugcccacggcug

SEQ ID NO: 53224 - RNA, 14 nt, Homo sapiens
uucauaacaucgaa

SEQ ID NO: 53225 - RNA, 17 nt, Homo sapiens
uucauaagaauucuguu

SEQ ID NO: 53226 - RNA, 15 nt, Homo sapiens
uucaugaaggggcgg

SEQ ID NO: 53227 - RNA, 18 nt, Homo sapiens
uucaugaaggggcggcgg

SEQ ID NO: 53228 - RNA, 19 nt, Homo sapiens
uucaugaaggggcggcggc

SEQ ID NO: 53229 - RNA, 16 nt, Homo sapiens
uucaugcauuugcacu

SEQ ID NO: 53230 - RNA, 14 nt, Homo sapiens
uucauuccauuugc

SEQ ID NO: 53231 - RNA, 14 nt, Homo sapiens
uuccaaauucacaa

SEQ ID NO: 53232 - RNA, 12 nt, Homo sapiens
uuccaagaaaua

SEQ ID NO: 53233 - RNA, 13 nt, Homo sapiens
uuccaagaaauau

SEQ ID NO: 53234 - RNA, 21 nt, Homo sapiens
uuccaagcaaguauuagaaua

SEQ ID NO: 53235 - RNA, 14 nt, Homo sapiens
uuccaauacauuau

SEQ ID NO: 53236 - RNA, 19 nt, Homo sapiens
uuccaggaaaaucugcacu

SEQ ID NO: 53237 - RNA, 18 nt, Homo sapiens
uuccagggcuacgcgcgc

SEQ ID NO: 53238 - RNA, 19 nt, Homo sapiens
uuccagggcuacgcgcgcu

SEQ ID NO: 53239 - RNA, 18 nt, Homo sapiens
uuccaucaaggguacacu

SEQ ID NO: 53240 - RNA, 15 nt, Homo sapiens
uuccauuccaagccu

SEQ ID NO: 53241 - RNA, 12 nt, Homo sapiens
uucccacacugu

SEQ ID NO: 53242 - RNA, 23 nt, Homo sapiens
uucccagcuagaauucacuccac

SEQ ID NO: 53243 - RNA, 12 nt, Homo sapiens
uuccccaaccac

SEQ ID NO: 53244 - RNA, 18 nt, Homo sapiens
uuccccuucccacacugu

SEQ ID NO: 53245 - RNA, 18 nt, Homo sapiens
uucccugaccucccucua

SEQ ID NO: 53246 - RNA, 11 nt, Homo sapiens
uuccgcauccu

SEQ ID NO: 53247 - RNA, 16 nt, Homo sapiens
uuccguggcacugcau

SEQ ID NO: 53248 - RNA, 17 nt, Homo sapiens
uuccguggcacugcaua

SEQ ID NO: 53249 - RNA, 18 nt, Homo sapiens
uuccuaacaggaauuuuc

SEQ ID NO: 53250 - RNA, 15 nt, Homo sapiens
uuccuagcgcagcca

SEQ ID NO: 53251 - RNA, 15 nt, Homo sapiens
uuccuauguaacugc

SEQ ID NO: 53252 - RNA, 16 nt, Homo sapiens
uuccuauguaacugca

SEQ ID NO: 53253 - RNA, 14 nt, Homo sapiens
uuccucacuuugaa

SEQ ID NO: 53254 - RNA, 15 nt, Homo sapiens
uuccucccggccgcg

SEQ ID NO: 53255 - RNA, 17 nt, Homo sapiens
uuccucccuggaaucuu

SEQ ID NO: 53256 - RNA, 16 nt, Homo sapiens
uuccuccgcugggccu

SEQ ID NO: 53257 - RNA, 20 nt, Homo sapiens
uuccugaacaggauauucuc

SEQ ID NO: 53258 - RNA, 14 nt, Homo sapiens
uuccugacugcuag

SEQ ID NO: 53259 - RNA, 15 nt, Homo sapiens
uuccuggacaguuuu

SEQ ID NO: 53260 - RNA, 16 nt, Homo sapiens
uuccuuaucacugaca

SEQ ID NO: 53261 - RNA, 19 nt, Homo sapiens
uuccuucucaucugugauu

SEQ ID NO: 53262 - RNA, 12 nt, Homo sapiens
uucgcgcgccuc

SEQ ID NO: 53263 - RNA, 23 nt, Homo sapiens
uucgcgcgccuccgcuacuucca

SEQ ID NO: 53264 - RNA, 19 nt, Homo sapiens
uucgugaaguauacuguau

SEQ ID NO: 53265 - RNA, 15 nt, Homo sapiens
uucgugaugacauau

SEQ ID NO: 53266 - RNA, 19 nt, Homo sapiens
uucuaaguaaaaccacagc

SEQ ID NO: 53267 - RNA, 19 nt, Homo sapiens
uucuacauacuauggaauu

SEQ ID NO: 53268 - RNA, 21 nt, Homo sapiens
uucuaggacugaauuaugaaa

SEQ ID NO: 53269 - RNA, 13 nt, Homo sapiens
uucuagugaccga

SEQ ID NO: 53270 - RNA, 14 nt, Homo sapiens
uucuaugaaauauu

SEQ ID NO: 53271 - RNA, 23 nt, Homo sapiens
uucucuaguucaaguucaccaga

SEQ ID NO: 53272 - RNA, 22 nt, Homo sapiens
uucucugccuugguauagcaua

SEQ ID NO: 53273 - RNA, 19 nt, Homo sapiens
uucucuggcgacaguuuuc

SEQ ID NO: 53274 - RNA, 12 nt, Homo sapiens
uucugaagaaga

SEQ ID NO: 53275 - RNA, 17 nt, Homo sapiens
uucugagaaagacuauu

SEQ ID NO: 53276 - RNA, 13 nt, Homo sapiens
uucugcaagcuuu

SEQ ID NO: 53277 - RNA, 17 nt, Homo sapiens
uucugcaagcuuuucaa

SEQ ID NO: 53278 - RNA, 23 nt, Homo sapiens
uucugcagauaaacaguagugau

SEQ ID NO: 53279 - RNA, 20 nt, Homo sapiens
uucugcccugcuuuugcuag

SEQ ID NO: 53280 - RNA, 18 nt, Homo sapiens
uucugucuggacuuucca

SEQ ID NO: 53281 - RNA, 21 nt, Homo sapiens
uucuuagggaaggauacaaaa

SEQ ID NO: 53282 - RNA, 15 nt, Homo sapiens
uucuucuugguucug

SEQ ID NO: 53283 - RNA, 14 nt, Homo sapiens
uugaaauagugucu

SEQ ID NO: 53284 - RNA, 20 nt, Homo sapiens
uugaaauagugucugaugaa

SEQ ID NO: 53285 - RNA, 20 nt, Homo sapiens
uugaaauauaggaacuuaaa

SEQ ID NO: 53286 - RNA, 17 nt, Homo sapiens
uugaaauuaaccauaga

SEQ ID NO: 53287 - RNA, 22 nt, Homo sapiens
uugaacaacucgaaucacucau

SEQ ID NO: 53288 - RNA, 15 nt, Homo sapiens
uugaacccaggagau

SEQ ID NO: 53289 - RNA, 13 nt, Homo sapiens
uugaacuuugacc

SEQ ID NO: 53290 - RNA, 19 nt, Homo sapiens
uugaagagguuuuaaagcu

SEQ ID NO: 53291 - RNA, 13 nt, Homo sapiens
uugaagauucuau

SEQ ID NO: 53292 - RNA, 17 nt, Homo sapiens
uugaagauuuaauuacu

SEQ ID NO: 53293 - RNA, 19 nt, Homo sapiens
uugaagcuuuaagaacuaa

SEQ ID NO: 53294 - RNA, 20 nt, Homo sapiens
uugaaggaguccuugcauca

SEQ ID NO: 53295 - RNA, 12 nt, Homo sapiens
uugaauccagaa

SEQ ID NO: 53296 - RNA, 19 nt, Homo sapiens
uugaaucccuuaaacucag

SEQ ID NO: 53297 - RNA, 22 nt, Homo sapiens
uugaauuguaggugacuauuau

SEQ ID NO: 53298 - RNA, 15 nt, Homo sapiens
uugacaacugugacu

SEQ ID NO: 53299 - RNA, 20 nt, Homo sapiens
uugacacuuaaaaaugguuu

SEQ ID NO: 53300 - RNA, 17 nt, Homo sapiens
uugaccucugcagcaau

SEQ ID NO: 53301 - RNA, 20 nt, Homo sapiens
uugagaaggagcucccagga

SEQ ID NO: 53302 - RNA, 16 nt, Homo sapiens
uugagauugugaaauu

SEQ ID NO: 53303 - RNA, 11 nt, Homo sapiens
uugagcaccug

SEQ ID NO: 53304 - RNA, 16 nt, Homo sapiens
uugagcaccugcaggc

SEQ ID NO: 53305 - RNA, 15 nt, Homo sapiens
uugagcuaggggggu

SEQ ID NO: 53306 - RNA, 20 nt, Homo sapiens
uugauaaucaacugggcuga

SEQ ID NO: 53307 - RNA, 17 nt, Homo sapiens
uugauuuuauaugcuau

SEQ ID NO: 53308 - RNA, 21 nt, Homo sapiens
uugcaaaguaucccuacugua

SEQ ID NO: 53309 - RNA, 15 nt, Homo sapiens
uugcaccaacuuuga

SEQ ID NO: 53310 - RNA, 23 nt, Homo sapiens
uugcaugguuuagaaagcuugcc

SEQ ID NO: 53311 - RNA, 16 nt, Homo sapiens
uugcauuuaauuuauu

SEQ ID NO: 53312 - RNA, 13 nt, Homo sapiens
uugccaugcuggc

SEQ ID NO: 53313 - RNA, 21 nt, Homo sapiens
uugccaugcuggccaggcugg

SEQ ID NO: 53314 - RNA, 20 nt, Homo sapiens
uugccgcuuaagcuuucagc

SEQ ID NO: 53315 - RNA, 21 nt, Homo sapiens
uugcuccuggcuggggccugu

SEQ ID NO: 53316 - RNA, 22 nt, Homo sapiens
uugcuccuggcuggggccuguu

SEQ ID NO: 53317 - RNA, 16 nt, Homo sapiens
uugcuggagcucugcc

SEQ ID NO: 53318 - RNA, 14 nt, Homo sapiens
uugcuugaacccag

SEQ ID NO: 53319 - RNA, 15 nt, Homo sapiens
uuggaaaaugugcaa

SEQ ID NO: 53320 - RNA, 17 nt, Homo sapiens
uuggaaaaugugcaaua

SEQ ID NO: 53321 - RNA, 17 nt, Homo sapiens
uuggacaaaauggaaua

SEQ ID NO: 53322 - RNA, 13 nt, Homo sapiens
uuggacucauuuu

SEQ ID NO: 53323 - RNA, 16 nt, Homo sapiens
uuggacuuccauuugg

SEQ ID NO: 53324 - RNA, 21 nt, Homo sapiens
uuggagaagaacugaaaucau

SEQ ID NO: 53325 - RNA, 19 nt, Homo sapiens
uuggauacuccauggggug

SEQ ID NO: 53326 - RNA, 16 nt, Homo sapiens
uuggaugcacuuuaua

SEQ ID NO: 53327 - RNA, 21 nt, Homo sapiens
uuggauucaauuuuaaggcau

SEQ ID NO: 53328 - RNA, 17 nt, Homo sapiens
uuggccagaagucaagg

SEQ ID NO: 53329 - RNA, 21 nt, Homo sapiens
uuggcccaggaguuuggccag

SEQ ID NO: 53330 - RNA, 23 nt, Homo sapiens
uuggcccaggaguuuggccagaa

SEQ ID NO: 53331 - RNA, 11 nt, Homo sapiens
uugggaaagga

SEQ ID NO: 53332 - RNA, 19 nt, Homo sapiens
uugggaggcugaggcgggu

SEQ ID NO: 53333 - RNA, 22 nt, Homo sapiens
uugggaggcugaggcgggugga

SEQ ID NO: 53334 - RNA, 12 nt, Homo sapiens
uugggcagguca

SEQ ID NO: 53335 - RNA, 15 nt, Homo sapiens
uuggggcugaugcag

SEQ ID NO: 53336 - RNA, 14 nt, Homo sapiens
uuguaaaauggugu

SEQ ID NO: 53337 - RNA, 18 nt, Homo sapiens
uuguaaaauggugugacc

SEQ ID NO: 53338 - RNA, 18 nt, Homo sapiens
uuguaacuguaaagauga

SEQ ID NO: 53339 - RNA, 24 nt, Homo sapiens
uuguaacuguaaagaugaauguca

SEQ ID NO: 53340 - RNA, 17 nt, Homo sapiens
uuguaacuuaugaaccu

SEQ ID NO: 53341 - RNA, 17 nt, Homo sapiens
uuguaaguuuaugcaua

SEQ ID NO: 53342 - RNA, 21 nt, Homo sapiens
uuguacauaaugcgugcauac

SEQ ID NO: 53343 - RNA, 16 nt, Homo sapiens
uuguaccgcaauguga

SEQ ID NO: 53344 - RNA, 17 nt, Homo sapiens
uuguagaagucacauuc

SEQ ID NO: 53345 - RNA, 18 nt, Homo sapiens
uuguagccacuucacuuu

SEQ ID NO: 53346 - RNA, 15 nt, Homo sapiens
uuguagcucucugac

SEQ ID NO: 53347 - RNA, 14 nt, Homo sapiens
uuguauaaaauaau

SEQ ID NO: 53348 - RNA, 14 nt, Homo sapiens
uugugaagaaacau

SEQ ID NO: 53349 - RNA, 20 nt, Homo sapiens
uugugauacaaugcugugcc

SEQ ID NO: 53350 - RNA, 21 nt, Homo sapiens
uugugcauuaucuagauacug

SEQ ID NO: 53351 - RNA, 15 nt, Homo sapiens
uugugggauacuauu

SEQ ID NO: 53352 - RNA, 18 nt, Homo sapiens
uugugugcacauauccuu

SEQ ID NO: 53353 - RNA, 21 nt, Homo sapiens
uuguguguuuauuucacuuga

SEQ ID NO: 53354 - RNA, 21 nt, Homo sapiens
uuguuaguaugaggcauuugu

SEQ ID NO: 53355 - RNA, 20 nt, Homo sapiens
uuguucccaaauuucauacc

SEQ ID NO: 53356 - RNA, 16 nt, Homo sapiens
uuguuggauaaaucag

SEQ ID NO: 53357 - RNA, 17 nt, Homo sapiens
uuguuucagugcacuaa

SEQ ID NO: 53358 - RNA, 18 nt, Homo sapiens
uuguuuucauuaucucaa

SEQ ID NO: 53359 - RNA, 21 nt, Homo sapiens
uuuaaaaaaaaauacugaugu

SEQ ID NO: 53360 - RNA, 13 nt, Homo sapiens
uuuaaaaaaugga

SEQ ID NO: 53361 - RNA, 21 nt, Homo sapiens
uuuaaaaucauuucugcauca

SEQ ID NO: 53362 - RNA, 18 nt, Homo sapiens
uuuaaaauuaaagcuaaa

SEQ ID NO: 53363 - RNA, 12 nt, Homo sapiens
uuuaaacuuuga

SEQ ID NO: 53364 - RNA, 18 nt, Homo sapiens
uuuaaaguaaaggcaaac

SEQ ID NO: 53365 - RNA, 21 nt, Homo sapiens
uuuaagaaaaaggaugcacag

SEQ ID NO: 53366 - RNA, 9 nt, Homo sapiens
uuuaauauc

SEQ ID NO: 53367 - RNA, 15 nt, Homo sapiens
uuuaauggcauguca

SEQ ID NO: 53368 - RNA, 17 nt, Homo sapiens
uuuaaugggcacagggu

SEQ ID NO: 53369 - RNA, 13 nt, Homo sapiens
uuuacuuccucag

SEQ ID NO: 53370 - RNA, 13 nt, Homo sapiens
uuuagcagauuua

SEQ ID NO: 53371 - RNA, 20 nt, Homo sapiens
uuuagcagauuuaagauaug

SEQ ID NO: 53372 - RNA, 21 nt, Homo sapiens
uuuagcauaguaccucugcua

SEQ ID NO: 53373 - RNA, 22 nt, Homo sapiens
uuuagcauaguaccucugcuau

SEQ ID NO: 53374 - RNA, 23 nt, Homo sapiens
uuuagcauaguaccucugcuauu

SEQ ID NO: 53375 - RNA, 12 nt, Homo sapiens
uuuagcuggaaa

SEQ ID NO: 53376 - RNA, 22 nt, Homo sapiens
uuuauaauguagcagcucauaa

SEQ ID NO: 53377 - RNA, 19 nt, Homo sapiens
uuuauauuugaaauauuga

SEQ ID NO: 53378 - RNA, 18 nt, Homo sapiens
uuuaucugcuaugcuauu

SEQ ID NO: 53379 - RNA, 13 nt, Homo sapiens
uuuaugcauacag

SEQ ID NO: 53380 - RNA, 13 nt, Homo sapiens
uuuaugcuuuaaa

SEQ ID NO: 53381 - RNA, 16 nt, Homo sapiens
uuuauuaccucugaua

SEQ ID NO: 53382 - RNA, 17 nt, Homo sapiens
uuuauuauuuucaccug

SEQ ID NO: 53383 - RNA, 18 nt, Homo sapiens
uuuauugaaaugauuuca

SEQ ID NO: 53384 - RNA, 15 nt, Homo sapiens
uuuauugcugaauga

SEQ ID NO: 53385 - RNA, 14 nt, Homo sapiens
uuuauugcuuguug

SEQ ID NO: 53386 - RNA, 23 nt, Homo sapiens
uuucaaacauauauaacaaugcu

SEQ ID NO: 53387 - RNA, 22 nt, Homo sapiens
uuucaagggaccucuccaugau

SEQ ID NO: 53388 - RNA, 18 nt, Homo sapiens
uuucacaaagaacaggaa

SEQ ID NO: 53389 - RNA, 19 nt, Homo sapiens
uuucacaaagaacaggaaa

SEQ ID NO: 53390 - RNA, 18 nt, Homo sapiens
uuucaugaaggggcggcg

SEQ ID NO: 53391 - RNA, 23 nt, Homo sapiens
uuuccacauaaggaaacuggguu

SEQ ID NO: 53392 - RNA, 15 nt, Homo sapiens
uuuccacuacugcua

SEQ ID NO: 53393 - RNA, 16 nt, Homo sapiens
uuuccagguuccugag

SEQ ID NO: 53394 - RNA, 22 nt, Homo sapiens
uuuccuagcgcagccaugugau

SEQ ID NO: 53395 - RNA, 16 nt, Homo sapiens
uuucuaugaaauauua

SEQ ID NO: 53396 - RNA, 18 nt, Homo sapiens
uuucuaugacacaugcaa

SEQ ID NO: 53397 - RNA, 19 nt, Homo sapiens
uuucucuaggaaauauuua

SEQ ID NO: 53398 - RNA, 20 nt, Homo sapiens
uuucucugauacagaaaagu

SEQ ID NO: 53399 - RNA, 11 nt, Homo sapiens
uuucugaaauu

SEQ ID NO: 53400 - RNA, 12 nt, Homo sapiens
uuucugaaauuu

SEQ ID NO: 53401 - RNA, 22 nt, Homo sapiens
uuucugagaaagacuauucaaa

SEQ ID NO: 53402 - RNA, 12 nt, Homo sapiens
uuucugcuuuaa

SEQ ID NO: 53403 - RNA, 19 nt, Homo sapiens
uuucuggcuaugcauuuga

SEQ ID NO: 53404 - RNA, 16 nt, Homo sapiens
uuucuucgugaugaca

SEQ ID NO: 53405 - RNA, 23 nt, Homo sapiens
uuucuuguaaggcauacugccuu

SEQ ID NO: 53406 - RNA, 20 nt, Homo sapiens
uuugaacaacucgaaucacu

SEQ ID NO: 53407 - RNA, 11 nt, Homo sapiens
uuugaacacaa

SEQ ID NO: 53408 - RNA, 11 nt, Homo sapiens
uuugagcucug

SEQ ID NO: 53409 - RNA, 20 nt, Homo sapiens
uuugaugauuaauucaccuu

SEQ ID NO: 53410 - RNA, 22 nt, Homo sapiens
uuugcagcuuucucuaguucaa

SEQ ID NO: 53411 - RNA, 10 nt, Homo sapiens
uuugccaugc

SEQ ID NO: 53412 - RNA, 14 nt, Homo sapiens
uuugccguuauuaa

SEQ ID NO: 53413 - RNA, 21 nt, Homo sapiens
uuugcuaagcauuccaacuau

SEQ ID NO: 53414 - RNA, 18 nt, Homo sapiens
uuugcucauggaauugga

SEQ ID NO: 53415 - RNA, 20 nt, Homo sapiens
uuugcugccucuaaaaggcc

SEQ ID NO: 53416 - RNA, 22 nt, Homo sapiens
uuuggcagugauauucaucaua

SEQ ID NO: 53417 - RNA, 17 nt, Homo sapiens
uuuguagcguacaucaa

SEQ ID NO: 53418 - RNA, 20 nt, Homo sapiens
uuuguauaaaauaauuuuua

SEQ ID NO: 53419 - RNA, 19 nt, Homo sapiens
uuugugaagaaacauuuau

SEQ ID NO: 53420 - RNA, 11 nt, Homo sapiens
uuugugaagca

SEQ ID NO: 53421 - RNA, 12 nt, Homo sapiens
uuugugaagcaa

SEQ ID NO: 53422 - RNA, 22 nt, Homo sapiens
uuuguuaguaugaggcauuugu

SEQ ID NO: 53423 - RNA, 14 nt, Homo sapiens
uuuuaaacuuugau

SEQ ID NO: 53424 - RNA, 23 nt, Homo sapiens
uuuuaaagcuuccauuguugucu

SEQ ID NO: 53425 - RNA, 15 nt, Homo sapiens
uuuuaaaugcaccug

SEQ ID NO: 53426 - RNA, 15 nt, Homo sapiens
uuuuaaggcauauuu

SEQ ID NO: 53427 - RNA, 14 nt, Homo sapiens
uuuuaagugcugca

SEQ ID NO: 53428 - RNA, 16 nt, Homo sapiens
uuuuacauacugcugu

SEQ ID NO: 53429 - RNA, 14 nt, Homo sapiens
uuuuacauggcugg

SEQ ID NO: 53430 - RNA, 13 nt, Homo sapiens
uuuuaguugucaa

SEQ ID NO: 53431 - RNA, 16 nt, Homo sapiens
uuuuauaaacuuuacc

SEQ ID NO: 53432 - RNA, 22 nt, Homo sapiens
uuuuaucgucacugcuuaacuu

SEQ ID NO: 53433 - RNA, 18 nt, Homo sapiens
uuuuaugaaacauuacag

SEQ ID NO: 53434 - RNA, 23 nt, Homo sapiens
uuuuauggaggcuuugcauagau

SEQ ID NO: 53435 - RNA, 19 nt, Homo sapiens
uuuuauggcuuuugugcau

SEQ ID NO: 53436 - RNA, 13 nt, Homo sapiens
uuuuauuuaaccu

SEQ ID NO: 53437 - RNA, 21 nt, Homo sapiens
uuuucaauaaaacuuuuccaa

SEQ ID NO: 53438 - RNA, 18 nt, Homo sapiens
uuuucacaaagaacagga

SEQ ID NO: 53439 - RNA, 15 nt, Homo sapiens
uuuuccuguucuuaa

SEQ ID NO: 53440 - RNA, 14 nt, Homo sapiens
uuuugaaaugucaa

SEQ ID NO: 53441 - RNA, 13 nt, Homo sapiens
uuuugcuguagaa

SEQ ID NO: 53442 - RNA, 17 nt, Homo sapiens
uuuugcuuuucaacaca

SEQ ID NO: 53443 - RNA, 16 nt, Homo sapiens
uuuugguugcuuuaau

SEQ ID NO: 53444 - RNA, 19 nt, Homo sapiens
uuuuuaagugcugcauuua

SEQ ID NO: 53445 - RNA, 17 nt, Homo sapiens
uuuuuccagguuccuga

SEQ ID NO: 53446 - RNA, 23 nt, Homo sapiens
uuuuuccuuccuuaucacugaca

SEQ ID NO: 53447 - RNA, 11 nt, Homo sapiens
uuuuugcagcu

SEQ ID NO: 53448 - RNA, 83 nt, Bordetella pertussis
aaaccuauuagaaaucaagugucuaaugaauuaugauaugagucugcauacauagacuuuggcgcuugauuccucauggcuuu

SEQ ID NO: 53449 - RNA, 63 nt, Bordetella pertussis
acaaggaguccggcgccucguuccuguacgugacgcacgaccaggaagaggcgcuguccaugu

SEQ ID NO: 53450 - RNA, 64 nt, Bordetella pertussis
acgaccagaucaugcgcuuggguuggaagaucuucaucccgcugaccggcguguggcuggucgu

SEQ ID NO: 53451 - RNA, 57 nt, Bordetella pertussis
acuguaaaccuuuuagaagugccuguuuucauugggaaaaucugaucgguaugcagu

SEQ ID NO: 53452 - RNA, 129 nt, Bordetella pertussis
agccuucguaagucuguccggcaccguggcggaccaugugcgagccgcucaggcccgcgguuacgccgacgccugccgcggccugcauggcguucgcgccggcguugauggucuggugcaguuggaggu

SEQ ID NO: 53453 - RNA, 64 nt, Bordetella pertussis
aggugaucgggcggcugggugacguccugcaggugcaggaugaggucggcgcgcucgaucucuu

SEQ ID NO: 53454 - RNA, 56 nt, Bordetella pertussis
aucagcggccuguugcgcgugggcgcgauugcgucggugcagcaggaucugcuggu

SEQ ID NO: 53455 - RNA, 77 nt, Bordetella pertussis
aucgugcuggugggcagcgaauucuggcacggccuggucgacuggcugggcgagcaauugcuggccaacggcaugau

SEQ ID NO: 53456 - RNA, 55 nt, Bordetella pertussis
auggcgucgggcgugcccuugggcgccacgaugccgaagaauacgcugacgucgu

SEQ ID NO: 53457 - RNA, 55 nt, Bordetella pertussis
caagcccgugcgccugcccuucaucgauacgcuggacaaggcgcgcgagguggug

SEQ ID NO: 53458 - RNA, 87 nt, Bordetella pertussis
cagcgcguggccgggguccugaggccaggccggaugguagaugcgcgcgaccucgggacggcccugcaggaacucgcacacgcgcug

SEQ ID NO: 53459 - RNA, 96 nt, Bordetella pertussis
cagcgccugggccuggcgcccaagguggcgcugcugucgcgcucgaacuucggcucgggcagcucggccucgggcgccaagaugcgccacgcgcug

SEQ ID NO: 53460 - RNA, 55 nt, Bordetella pertussis
cagggucagcgcguacgacaugcggcgcuugguggccgugggcacgcugaccuug

SEQ ID NO: 53461 - RNA, 60 nt, Bordetella pertussis
caguacggcgccagccccgaccugggcccggggcgccagggacgggagggugccgaacug

SEQ ID NO: 53462 - RNA, 67 nt, Bordetella pertussis
cauggcguuguugaccagcacuuuguccaugaccaccuggaagaacaagggcgucaacagggcaaug

SEQ ID NO: 53463 - RNA, 89 nt, Bordetella pertussis
ccagcagcuugaggucggcggucaggccgaugcagccgaagaagaucagcagcaggguggguuugauguuggucucgagcgagaucugg

SEQ ID NO: 53464 - RNA, 98 nt, Bordetella pertussis
ccagcagugcaauggggaucaacuuccagaucaugggcaacuccuuaaaacugggaacagacggaauguccaugauaguugaggccgggcacgguugg

SEQ ID NO: 53465 - RNA, 84 nt, Bordetella pertussis
ccagcggcgccugguugcagcacgugccguaucgagguugcggcccggcgcugacggacgugcugucgcggcaggugccgcugg

SEQ ID NO: 53466 - RNA, 80 nt, Bordetella pertussis
ccauuucagcucgcugacgcuggaccgcggcuaucugaucaagugggccgugggcagcgucgugcuggggcugugccugg

SEQ ID NO: 53467 - RNA, 60 nt, Bordetella pertussis
cccgcggcccggccccagauggccgauugcaucagcacgaacagauuguccgggccgggg

SEQ ID NO: 53468 - RNA, 73 nt, Bordetella pertussis
ccgccagguggguauccaucagccccagcgagguguacagcuggaagaaaggcagcaggaacaccgccggcgg

SEQ ID NO: 53469 - RNA, 60 nt, Bordetella pertussis
ccgccgccgcccugcugcaccugacccagagcgcggucagccagcaguugcagcggcugg

SEQ ID NO: 53470 - RNA, 68 nt, Bordetella pertussis
ccggacagcgucuggaugacgcgaugcguggaacgcgcguucgcgcgccugucgugcggauuugccgg

SEQ ID NO: 53471 - RNA, 58 nt, Bordetella pertussis
ccugaaugccagcgcgaccucgcagggcgcccccuucgacgucauccugcgcuucggg

SEQ ID NO: 53472 - RNA, 80 nt, Bordetella pertussis
ccuguaccaauuguggauguucucccugguggucugguacgccuaccgcgacccgggcagcagcgccaucaugcggcagg

SEQ ID NO: 53473 - RNA, 57 nt, Bordetella pertussis
ccuucggccgcauccugcucaaggucaauagggacggcucgcaggugcgccugaagg

SEQ ID NO: 53474 - RNA, 83 nt, Bordetella pertussis
cgauggcggggauggaguucagcagcucgcagucuugcuugaggucggggugguugucgaugugcugaucgaucgcccgcucg

SEQ ID NO: 53475 - RNA, 130 nt, Bordetella pertussis
cgcaccggguggcgcccggucaugagcgccgaacgcgugggcacgcaaucgcuuuccacguugaaguugagaaacugcgugcccugcgcggccagcgcaucgauacgcggcgugggcgccccgcggaugg

SEQ ID NO: 53476 - RNA, 62 nt, Bordetella pertussis
cgccgacagcacgcgccgcaagggcagugcgcaggcgcuguucgcggccgugcaugccggcg

SEQ ID NO: 53477 - RNA, 62 nt, Bordetella pertussis
cgccgugguggcggccgacauaccauucggggaagaguucgagcucggccgccagccgggcg

SEQ ID NO: 53478 - RNA, 82 nt, Bordetella pertussis
cgcgacgcugcgguggccggcauccgcaagcugcugggcaucgcgccgggccagccggugccggccgaccaagucgagugcg

SEQ ID NO: 53479 - RNA, 60 nt, Bordetella pertussis
cgcgccagccugcgcaaccugcugaaccauuaccugaucaccacggccgggcugagcgcg

SEQ ID NO: 53480 - RNA, 59 nt, Bordetella pertussis
cgcgcgcggcgcggaugcgcagcaaaucgccggggauggcauccgacgccgugcucgcg

SEQ ID NO: 53481 - RNA, 70 nt, Bordetella pertussis
cggcaauccagccguucgguucgcaagcuggcggccgcccugcaggugaaccuggacuggcuggagaccg

SEQ ID NO: 53482 - RNA, 99 nt, Bordetella pertussis
cggaucgcucagcguguccgccgugagccacagaaugcccgccgacagauggcccggcaucgcgcgugcgcugcgcgcggaaaugcaugagauacaccg

SEQ ID NO: 53483 - RNA, 67 nt, Bordetella pertussis
cggauuggcgcugcacagggaccaccccgagauaggcggccaggcucugggcggagucgauaugccg

SEQ ID NO: 53484 - RNA, 113 nt, Bordetella pertussis
cggccgcgugcuggacgcccagccgccgcugcuggugcaggagcgccugcuguuucgcgucaucuggaucggcuucgugguccugacccuggcggugggcuccggcucggucg

SEQ ID NO: 53485 - RNA, 111 nt, Bordetella pertussis
cgucguucggcuggcgccugggccugaccgugcugggcgcuuuccugacggccggguuccugaugcugggcgugaccgccaugcaggcccugcgccgcccgcuggacgacg

SEQ ID NO: 53486 - RNA, 64 nt, Bordetella pertussis
cguggaugauggccucggcgcgggccagcaccaccaggcccagcggcgugggcgucaugccgcg

SEQ ID NO: 53487 - RNA, 89 nt, Bordetella pertussis
cuauucgaacggccugaccgguuuccugggcgggcugagcgccaacacgcugggccugcugggcaaccuggugacgcuggacguggugg

SEQ ID NO: 53488 - RNA, 91 nt, Bordetella pertussis
cugccgccgguguccgauaccgugcccggcuacgacgccgauaucuggcugggcgugugggccguggccgguacgccggacacgguggugg

SEQ ID NO: 53489 - RNA, 59 nt, Bordetella pertussis
cuggugaucggcugcucgaccuuccccaccuggaacggcuauccgggccuguucgccag

SEQ ID NO: 53490 - RNA, 73 nt, Bordetella pertussis
gaaagucggcgaagggcgcguuggugauguacagcuugcugccgugcaggcgccagccgcccucgacgcgcuc

SEQ ID NO: 53491 - RNA, 67 nt, Bordetella pertussis
gacguuacgugccuuccgggcgcaacuggccguccagcgcggccagccgcugggggguacccacguc

SEQ ID NO: 53492 - RNA, 72 nt, Bordetella pertussis
gagaauccgcauuuguggacgccggaguuccgcgaagaaauccgcgaacucuuccgcaaagcggucgaacuc

SEQ ID NO: 53493 - RNA, 81 nt, Bordetella pertussis
gaugcgggucucgaugcgauggcggccauccuccaugcaccagcgcaccagggcaaggucgccguggcagcgccccucguc

SEQ ID NO: 53494 - RNA, 84 nt, Bordetella pertussis
gcaccgaacugcagcagggccugcguuucgcuggcaucgaucuugacgaugcccagcgguugcgcggccaggcgcaggcggugc

SEQ ID NO: 53495 - RNA, 62 nt, Bordetella pertussis
gcagcaggcacccggccagcgucgcguccggauagucgcgccgcagguccggcgccugcagc

SEQ ID NO: 53496 - RNA, 65 nt, Bordetella pertussis
gcagcagggccagcaccgagccauagagcagcggcugcugcagaucguucuugccggccuugugc

SEQ ID NO: 53497 - RNA, 102 nt, Bordetella pertussis
gcagccgccagcgccacaucgagaaccugauggaccacuggcagccgcccgucgauggcgcgcgccugguggccacgcugcuggaucgcgaaggcgagcugc

SEQ ID NO: 53498 - RNA, 77 nt, Bordetella pertussis
gcagggugggccggcacaggaagcgccagcaaucggccagguccuggcgaaacgucguggcgcgcgccgcgcccugc

SEQ ID NO: 53499 - RNA, 129 nt, Bordetella pertussis
gcaugccggccuucgucgccgccaugaacgccaaggcgcguucgcugggcaugcugaacacgcgcuucgucgagcccaccggccuguccagcgagaacguguccucgccgcgcgaccuggcccgcaugc

SEQ ID NO: 53500 - RNA, 82 nt, Bordetella pertussis
gccaagaucgccgguucgggcggcuaccuucccgaacgcgucgucaccaacgacgaucuggccgccgagcuggcgacgcggc

SEQ ID NO: 53501 - RNA, 59 nt, Bordetella pertussis
gccagccggcccacgaaggcgagauuaugcucgacgaaaacuaccguggcgccguuggc

SEQ ID NO: 53502 - RNA, 69 nt, Bordetella pertussis
gccgagacggucgagcacaugcugacgcaggccgcggccagcggccuguccaucaugugcuucgucggc

SEQ ID NO: 53503 - RNA, 80 nt, Bordetella pertussis
gccgccccggucggggcguugcaugcugcccacccggccccugugccgcgugggcauuuugcugcgcccgccgggccggc

SEQ ID NO: 53504 - RNA, 61 nt, Bordetella pertussis
gccggaucggccgccuucagcgcgcccaucacgguuucgcucuggguggccgaggucuggc

SEQ ID NO: 53505 - RNA, 55 nt, Bordetella pertussis
gccggcguggucgacgaggccauggcccaggccgccgaucugcugccaugccggu

SEQ ID NO: 53506 - RNA, 80 nt, Bordetella pertussis
gccgggcgcgcagcgccgcggccgcgucgucaugaacagucaugaaaauuccuugagcgcccggcgcuacaccgccuggc

SEQ ID NO: 53507 - RNA, 75 nt, Bordetella pertussis
gccgucgugcaggccaugaacgaccgcuucgagaccgcggccaucgccaucuucguggccauggugcucgacggc

SEQ ID NO: 53508 - RNA, 62 nt, Bordetella pertussis
gccgugugcuugaugaauggagaaauacgcauagcccucgugcuccgugugcggcgcgcggu

SEQ ID NO: 53509 - RNA, 87 nt, Bordetella pertussis
gccuaucccccgcuaucgggcauccugcacaguccggacgugggggucgacuacuacaucuggaccuugcagaucgccggggugggc

SEQ ID NO: 53510 - RNA, 70 nt, Bordetella pertussis
gcgcaggugcaggccgcccucggcgcccggaaucgccgggucgucggccucggcggccgaguagccgcgc

SEQ ID NO: 53511 - RNA, 70 nt, Bordetella pertussis
gcgccgccgggcgccaccgugcuggcgcgcucggcccaggacgcgcaccagauacugcgccuggccccgc

SEQ ID NO: 53512 - RNA, 58 nt, Bordetella pertussis
gcgcgucgugaaugcccaucagcugcuuggaaaaagccgugaaggcaaucgcgccggc

SEQ ID NO: 53513 - RNA, 62 nt, Bordetella pertussis
gcgcgguagaucgccagguguucuucgugcaccgcgugcacagggucgcccuggcgccgcgu

SEQ ID NO: 53514 - RNA, 78 nt, Bordetella pertussis
gcggcacgaccuugaucuugcuggcgucgccgaacaccgccgcggcgacggcacggcacaggucgacguccaggccgc

SEQ ID NO: 53515 - RNA, 80 nt, Bordetella pertussis
gcggugaccgugggcuuguccuugcuguccaggcgcggcgcguggcccuggaccagcucgcgggcgcgauaggucgccgc

SEQ ID NO: 53516 - RNA, 95 nt, Bordetella pertussis
gcgugccggcggcauccagcccggcggccuggcgcagcaucucggcguagcugccgugcgcggcgcgcagggcggcggcgggauugccgguaugc

SEQ ID NO: 53517 - RNA, 89 nt, Bordetella pertussis
gcgugcugcguauaccgugggcagcuggucguagucgguaucggccggagcgaccgccagccagcagcccgcgccaaacgccgccacgc

SEQ ID NO: 53518 - RNA, 61 nt, Bordetella pertussis
gcgugggccgggcccggcacugccaacugcagaugcugguucuccagcuuggcgaccacgc

SEQ ID NO: 53519 - RNA, 61 nt, Bordetella pertussis
gcuagcuccugucgugggucgcuucugguuugauuguaaugacccgcggggggauggcggc

SEQ ID NO: 53520 - RNA, 69 nt, Bordetella pertussis
gcuccuucggccugcgugcgcacgaugaagccgccuuucuccuccggcggcaucagcgccugcaggcgc

SEQ ID NO: 53521 - RNA, 87 nt, Bordetella pertussis
gcugaagccgggaaagaagaaaugcuugaccaggccgucggcgcgcugcgagggcaggccguggcagguuuccacccaggcuucggc

SEQ ID NO: 53522 - RNA, 55 nt, Bordetella pertussis
gcugcugguggucgacggucaggugggcuuccugggcgggcugaauaucagcagc

SEQ ID NO: 53523 - RNA, 60 nt, Bordetella pertussis
gcuggguacguugcuggucggcaucgccuucggcggcagcaucgucagcggcgugacggc

SEQ ID NO: 53524 - RNA, 112 nt, Bordetella pertussis
gcuggugaccucgcgcugggccggcaagcugaccgugaucgaccuggagaccaaaaaggugagccagcaggugcgugucggcaaaucgccgcacgguguguggacgcucggc

SEQ ID NO: 53525 - RNA, 90 nt, Bordetella pertussis
gcugguggagacgaaagcgcuguugcugcugccgaccuggcaggaacguccggucagauggucgagcacauugucguuguuuccccacgc

SEQ ID NO: 53526 - RNA, 70 nt, Bordetella pertussis
gcugguucgaaggcagcgccucgaucaccuccauggucaacgacaaggccugggaagcgcugccgccggc

SEQ ID NO: 53527 - RNA, 90 nt, Bordetella pertussis
gcuucucguacaggcccagguugaucgcccaugugccauuggaccccaugacgaugguauagccaucggcggccugcuuggcgacauagc

SEQ ID NO: 53528 - RNA, 79 nt, Bordetella pertussis
ggaugcgcaggagcagaccuucguugaucguacccugaucgaacucgacggcaccgacagcaaggagcgccugggcgcc

SEQ ID NO: 53529 - RNA, 59 nt, Bordetella pertussis
ggcagcacgccgaagccgucgaucagauacaggccuucgcggccuucggcauugcggcc

SEQ ID NO: 53530 - RNA, 71 nt, Bordetella pertussis
ggcagcaggauguugcggcgaauguugcgccauucaagcagcgcgucgcgcuggaacaccaugccuaugcc

SEQ ID NO: 53531 - RNA, 66 nt, Bordetella pertussis
ggccaugaugggcccggcggucaggccgaacuggccgacuuucaugcccggccaguuaugcaugcc

SEQ ID NO: 53532 - RNA, 85 nt, Bordetella pertussis
ggccgcgugcccuacaagggcagcgugcuggccaucaucuaccagcuggugggcggcauccgcgccucgaugggcuacugcggcu

SEQ ID NO: 53533 - RNA, 91 nt, Bordetella pertussis
ggccggguccugcagcagcgcggcaucgaccgcgccgauuuccccuucggccuucuugagcagguugccgaugcgcuuguuggccgcggcc

SEQ ID NO: 53534 - RNA, 56 nt, Bordetella pertussis
ggccgugggcgccgacgugcgucaccucaagaagggcgaccgcgucgccuauggcc

SEQ ID NO: 53535 - RNA, 72 nt, Bordetella pertussis
ggcgagguugacgcgcuugcccagcagguucagcuccagccccagcaggcgcuugcgcgucagguucucguc

SEQ ID NO: 53536 - RNA, 85 nt, Bordetella pertussis
ggcgcaggaugcgguagugguuggggcugccgucgggcaggcggcgcggcagcaggaacagcgacacgccgcgcaggccugcguc

SEQ ID NO: 53537 - RNA, 58 nt, Bordetella pertussis
ggcgcgcaaugcgcguuacgcaucgccaacuggcgagugggcagggugcaugcgcgcc

SEQ ID NO: 53538 - RNA, 89 nt, Bordetella pertussis
ggcgcgcagcagcaggcgcauggugugcagauggcgcgcgccgccguccugcagcggcuccagcagguccagcgccugcugggcgcgcc

SEQ ID NO: 53539 - RNA, 71 nt, Bordetella pertussis
ggcgcggcguccuacaacaugaagcugccgccauucacgucgaugguggcgcccgugguguagcccgcgcc

SEQ ID NO: 53540 - RNA, 86 nt, Bordetella pertussis
ggcgcugcgcuaucugccgcagagcacggucaugaugggcgugccuaccuauuacgugcggcugcuggccgaugcgcgcuucgacc

SEQ ID NO: 53541 - RNA, 103 nt, Bordetella pertussis
ggcgucgucgaucuccagcagcgcgcccuuggggccguggccggcgcuguugacgaccgcgucgauacggccccagcgcugcaggguggcgucgaccagcgcc

SEQ ID NO: 53542 - RNA, 84 nt, Bordetella pertussis
ggcguugaacagcaggaugucggcggccaucaggacgggauacgagaacagucccauggucacgccgucauccggcucgacgcc

SEQ ID NO: 53543 - RNA, 66 nt, Bordetella pertussis
ggcguugaagccauggcucuggccauagccgguggacaggcuguagcugaagccgucggccgcgcc

SEQ ID NO: 53544 - RNA, 58 nt, Bordetella pertussis
gggcugcggcgugcccggcggcgcgaugacgcccagccaguuggucaccucguagccc

SEQ ID NO: 53545 - RNA, 130 nt, Bordetella pertussis
gggcuuggcggcggcgccgcgcgcaucgacaucgagcucgcgguccagccauucgagcagggccggcggcagggccggccuggcgggggcggcggcggccaguucggcgcgcagcggcgccggcaauucc

SEQ ID NO: 53546 - RNA, 69 nt, Bordetella pertussis
gggcuuggggcgcgagauguagucgucgaacuccucgggcagcggcguccacaucucgugcaccagccc

SEQ ID NO: 53547 - RNA, 67 nt, Bordetella pertussis
ggucgaggccgucuuuggcguaugggcguucguacugaucgccuguauggcgcugauggccggcacc

SEQ ID NO: 53548 - RNA, 101 nt, Bordetella pertussis
ggucggcgcucagccggcgccacaccggcguggucagcggcgcauugguggguuccaugaugugcagcgccaccaggcuggucugcgccugcgcggcgagc

SEQ ID NO: 53549 - RNA, 73 nt, Bordetella pertussis
ggucuccaguuccagcccuucgaugguguagccgggcagguugcgguaguuggacaagggcuuggggcagucc

SEQ ID NO: 53550 - RNA, 72 nt, Bordetella pertussis
ggugaggauggggccgagcgcccagucgcggcccucgaagccguugaggcggucggccgucgggcccuuguc

SEQ ID NO: 53551 - RNA, 64 nt, Bordetella pertussis
ggugcagcuggccgcccagaaggccgaacugaccaucaacggcauccccguggucagcgacacc

SEQ ID NO: 53552 - RNA, 121 nt, Bordetella pertussis
gguggcgcgccagcgcgguaaccuggauguccauguacgggaacagcggcagcgccgacagcaucuggugcagcucgucguugucggcggcgucgaagaugcugacguuggcguagcggcc

SEQ ID NO: 53553 - RNA, 75 nt, Bordetella pertussis
guagcuucaacgcuucagggcagcaucucagaguuuuucuggagaaauaugcugcuaugaagcguuguuuccuac

SEQ ID NO: 53554 - RNA, 68 nt, Bordetella pertussis
gucgcagcaagcggcugagcugaaggauccgcaagacguugccucguucaccagcggcuuggugcagc

SEQ ID NO: 53555 - RNA, 56 nt, Bordetella pertussis
gucgcaggugcgcaugcccaauggccagaucaaggccgugggcgaguaccuugugc

SEQ ID NO: 53556 - RNA, 66 nt, Bordetella pertussis
gugccuguccccgcaugggggagcgacacccgcggcaagggugccuguccccgcggggacaggcac

SEQ ID NO: 53557 - RNA, 74 nt, Bordetella pertussis
gugccguucuucagggcgaccuugaacaugccgcggcgggccuguuccauugccuucugaaccgacaccggcac

SEQ ID NO: 53558 - RNA, 80 nt, Bordetella pertussis
guggcaggggccccgcggcccccugguuggaauuggcacuguagcgggaaagcaggggguugccgacgggggauugcgac

SEQ ID NO: 53559 - RNA, 83 nt, Bordetella pertussis
gugugcagcuugcgcgaggacgcacugaagcugcccagcacggcgcuccaguagaacgccucgaguugcuucaggguguacau

SEQ ID NO: 53560 - RNA, 92 nt, Bordetella pertussis
guugauggucuuguucuucauguagcucgccagcagcgucagcgagguguccgggcugaugcgccaggucagcgcgggggcgagauaguagc

SEQ ID NO: 53561 - RNA, 81 nt, Bordetella pertussis
ucaccaccuggccgucgugcaccagaaccugcuuuuccuucaggaucaggaacucguggcugacgccuuccaggucgguga

SEQ ID NO: 53562 - RNA, 81 nt, Bordetella pertussis
ucagccgauugcccugcuccugggcgcggcgcaggcgguucaucucggccagcaggugcggcgucagguugggacggcuga

SEQ ID NO: 53563 - RNA, 61 nt, Bordetella pertussis
uccugcaggaacacgagauccggccgugccucgcgcagggccucgcgcaguucgugcagga

SEQ ID NO: 53564 - RNA, 129 nt, Bordetella pertussis
uccuguaugcgggcgcgugguccgcgcgaaaccugaaugauggcgguuccgugcgucuggccgcgcgcagcgaacauuucgucuauucgcaguucgcgcaguuccuggacgcgcguuggcgcuacagga

SEQ ID NO: 53565 - RNA, 70 nt, Bordetella pertussis
ucgcgcagcgucuccaggaagccggcgagcacugucagcggcgugcgcagcucgugcgagacguuggcga

SEQ ID NO: 53566 - RNA, 58 nt, Bordetella pertussis
ucgugggccugaacgguggcggccagaucggccugggcccggagccguucgcccaugg

SEQ ID NO: 53567 - RNA, 72 nt, Bordetella pertussis
ugacgguguucggcgaugccgccauccacgccauccuggucgaaggcaugggcagccucgccgagaccguca

SEQ ID NO: 53568 - RNA, 84 nt, Bordetella pertussis
ugauggccaaggaugccggcggcggcgcgcccaaccccgaggcuccccucgaggcgggcgaagucaccgucagcaucgccguca

SEQ ID NO: 53569 - RNA, 55 nt, Bordetella pertussis
ugcgccgggcccugggcgacgcccugcgccagcugcagggccuggggcccgagca

SEQ ID NO: 53570 - RNA, 57 nt, Bordetella pertussis
uggcagcagaucgacuacggcucgcgcuauuccgagucguacauggauucgcugccg

SEQ ID NO: 53571 - RNA, 70 nt, Bordetella pertussis
uggccgaugugcagcgcuugcagccggcguuccuggccgggcgcaggcugcuggugcuggggggcggcua

SEQ ID NO: 53572 - RNA, 74 nt, Bordetella pertussis
ugguggcgcagggcagcgcgcaggaccugaucgacgcccccgagucggucaccggccgcuaccuggccaagccg

SEQ ID NO: 53573 - RNA, 84 nt, Bordetella pertussis
uguauuaccugcagcgggccuggcccgccauccgcgaaaagucgcagugagcguacgcggccgggcgcaggcccgggcaauaca

SEQ ID NO: 53574 - RNA, 75 nt, Bordetella pertussis
uugcugggccuggauggcgccgcauuguccgagcugguggggcaguggggcggcaagccguuucgcgcccggcaa

SEQ ID NO: 53575 - RNA, 78 nt, Chlamydia trachomatis
guucuaucuacguucaugucguucagaaugcaacgggcccuucuguugauuaucccgaagauauaaccaaaguggagc

SEQ ID NO: 53576 - RNA, 58 nt, Chlamydia trachomatis
guauauuuauauugcccuucuuuccugaaguugcaagauagagggcaaauagauauau

SEQ ID NO: 53577 - RNA, 75 nt, Chlamydia trachomatis
cgcuggauucucugguauuaacugguuuuuuacgcaaaaucuagcaaaacuuuuaauagcagauagucgacggcg

SEQ ID NO: 53578 - RNA, 129 nt, Chlamydia trachomatis
augagggacauaucuugauuaggauccggcgaggaagaggucuuuuauguugcgcuuguuucaacauauauuguguuuuuuagaagaagacccuucguuuguagacgucccucaagagcuuucuuuugu

SEQ ID NO: 53579 - RNA, 129 nt, Chlamydia trachomatis
agagauuucucaggcuauucaauuuuucaaucaaaacaguauggggguccacgcucuuaucaucgcaaggggcgguggaaguaucgaggaucucugggcuuuuaaugaagaagagcuaguuaaaucuau

SEQ ID NO: 53580 - RNA, 62 nt, Chlamydophila pneumoniae AR39
cggcccuaucuauaaaacaucaguugcuugcuuauggcaucuccgcaacuguuguagacccg

SEQ ID NO: 53581 - RNA, 78 nt, Chlamydophila pneumoniae AR39
gauuuuuccauauauuuagccucuccugauuauugaaaaguuggaaaucauugaaagguugaacgucgugggggacuc

SEQ ID NO: 53582 - RNA, 92 nt, Chlamydophila pneumoniae AR39
ucuuuaucucagguagagaggcaagaauacgauggcugcuaguauuuuaucucaggagcuuuuggauauccuuccuuauacuuuuuuaaaga

SEQ ID NO: 53583 - RNA, 68 nt, Chlamydophila pneumoniae AR39
uagaaguauuaagccaagauuuuauuugugcugcuaaagcucgaggauugcguugguuugauauucua

SEQ ID NO: 53584 - RNA, 56 nt, Chlamydophila pneumoniae AR39
uagcaaguaugcgauacgcaauaguguuuccaucuauaguaaguucaugcuuguua

SEQ ID NO: 53585 - RNA, 65 nt, Chlamydophila pneumoniae AR39
uaaagaagaagaauccguggaugaugaagucucagauggcucgucuacaggguucuucgcuuuua

SEQ ID NO: 53586 - RNA, 80 nt, Chlamydophila pneumoniae AR39
uaacgaaccuuuauauacccucgcucuuaagauuauggaaucugcuuuaagucguggguauguuccuggaggaggcguug

SEQ ID NO: 53587 - RNA, 106 nt, Chlamydophila pneumoniae CWL029
guuuuaaauccuuguuguauauaaaaguguaugaguuucucuucauccacaggguguuguggaaagguaagggacucuauugguacugggauagggauauuagaau

SEQ ID NO: 53588 - RNA, 110 nt, Chlamydophila pneumoniae CWL029
gaaaagacaagugacggguaggaucuuagaauguuguaggucucgggucuuuuuuucaccuggauucuuuaauuuucugaaagauuauaggaacucuucuuuuguauuuc

SEQ ID NO: 53589 - RNA, 104 nt, Chlamydophila pneumoniae J138
gaaauagugaaugagacuaaauauugaccuuuagcugcaggagguuuggccuuaauuaaagcagaacuuagagcuucaauauuuucuuugauuugacugcuuuc

SEQ ID NO: 53590 - RNA, 124 nt, Chlamydophila pneumoniae J138
cagucaucaaaacuuucaauuuuaaacacacuuuugucguauuuguuauuacuaguugucugaagagucauuuugagacccgcgaguaaagauucuaauacaguaaguugguuuaaagugacug

SEQ ID NO: 53591 - RNA, 59 nt, Escherichia coli CFT073
caguaccguuagugccguccgcuuuacccugcgccguaccgacauugauggucccacug

SEQ ID NO: 53592 - RNA, 63 nt, Escherichia coli CFT073
caguguaaaagguauguaacagaccauugacugacugaauggucugucauacuuuguuaccug

SEQ ID NO: 53593 - RNA, 79 nt, Escherichia coli CFT073
caucaugaacagcauggggaaugaucagauccggacuguuaaucugauuaaaucugcccguguuggcuauacaaagaug

SEQ ID NO: 53594 - RNA, 67 nt, Escherichia coli CFT073
caucuugcauucugguuguaaguaauggcggcacuugggccgauucuuaaaaaccggaggcaacaug

SEQ ID NO: 53595 - RNA, 56 nt, Escherichia coli CFT073
caugaugggcaugaaugucauaaccuugagugauguggcuuuucuugccgauuaug

SEQ ID NO: 53596 - RNA, 59 nt, Escherichia coli CFT073
cagcagcaguaugcagacgcuggcgaaggcaaauuugccgccguugcuuucuguuccug

SEQ ID NO: 53597 - RNA, 59 nt, Escherichia coli CFT073
cagccaguuaacgcuggcgcagcagaugcgagcugaaaaauuacgccagcgacugguug

SEQ ID NO: 53598 - RNA, 67 nt, Escherichia coli CFT073
ccaggcugaagguguuuuucagauccgcaccgagacacagcacaggcggaacauuuuuaaagcccgg

SEQ ID NO: 53599 - RNA, 100 nt, Escherichia coli CFT073
ccauaugcacaucaaucgcuaugccugcaugaacgcgaaaaccaucgcggcuuguuguucauguaugcauguuugcugggggcgaugauguguuuuaugg

SEQ ID NO: 53600 - RNA, 63 nt, Escherichia coli CFT073
ccacgcccaguccgccgcgcauuuuccccaccagaacguuggcaaugugcaggaugcguucgg

SEQ ID NO: 53601 - RNA, 70 nt, Escherichia coli CFT073
cauuauggcgcugauggugauguccugcugcgguucgcugcuuggcuggcaguucaccauugcccaggug

SEQ ID NO: 53602 - RNA, 66 nt, Escherichia coli CFT073
cauuucauguguugucagugcaguggggugccgugggugucccacaaugccaauacacuugaaaug

SEQ ID NO: 53603 - RNA, 65 nt, Escherichia coli CFT073
ccaauaugcaaaacugcggcgcauuacgaauugaucacgugaugucgaugcugcguuuguggugg

SEQ ID NO: 53604 - RNA, 82 nt, Escherichia coli CFT073
augcaccaccaauagcaccgagaacaguaccgcgcugaccauuaagaucacagugguacucaauuucaucggacguuugcgu

SEQ ID NO: 53605 - RNA, 100 nt, Escherichia coli CFT073
aucuugucagaaccggcgcguuucugguggcgaugucccuguggcauaaccauccacagaaaacgcagucaccgucaaugaaugaggccgugaugaagau

SEQ ID NO: 53606 - RNA, 65 nt, Escherichia coli CFT073
augaauauuuagacuaaagaguuuguaacgcuauguaagugauuuuuucugguuuagauauuuau

SEQ ID NO: 53607 - RNA, 55 nt, Escherichia coli CFT073
auccuuaaccaugccgauaacgugauuaaucaacaaacgcgcaugcgucagggau

SEQ ID NO: 53608 - RNA, 111 nt, Escherichia coli CFT073
aucaguuauuaauaucgguagaaugacaaucgacggcuuuagauacugauaucuacgcauugaacgguauuuaacgccgucagaaaugucauuacuuuguuaaauauagau

SEQ ID NO: 53609 - RNA, 67 nt, Escherichia coli CFT073
auaguaagguuguucacuguaaggguuguaaacuucccauuaucaccaguaaaacgcaccauacugu

SEQ ID NO: 53610 - RNA, 86 nt, Escherichia coli CFT073
auguaucaacagauucagcaggaagaugccucucaguugcggcacauuugccugacagauaugguacuucccgcugaugauggcgu

SEQ ID NO: 53611 - RNA, 101 nt, Escherichia coli CFT073
auguuucaaaugcacaaaacuuuuauacucuaagaaaucaggauugcaccaguacaagcagccugauguuugacgaguauuuaacuuguuaugaauaacau

SEQ ID NO: 53612 - RNA, 61 nt, Escherichia coli CFT073
caagguaacgucugguccuguaaccagcuugguuauauguauuccagagguuuaggcguug

SEQ ID NO: 53613 - RNA, 100 nt, Escherichia coli CFT073
caaauucaguuuucaucguaguaucacuuuaucagccaagucauaaaguucagcuguauuuugggagguaaagcgauauuaugauuauauuuuauguuug

SEQ ID NO: 53614 - RNA, 82 nt, Escherichia coli CFT073
caacgugucgacacucuuccucuuuauuuacaugcuuaugccuuucauuuaaauaugcgacuggaaagaguguugccugcug

SEQ ID NO: 53615 - RNA, 59 nt, Escherichia coli CFT073
caacugagaggcucuuugcuaaguguacggaaaugcuuaaaucgagagccuccuaauug

SEQ ID NO: 53616 - RNA, 69 nt, Escherichia coli CFT073
auuugcuccguaaaacgcaaucaaaaugaggguauuugcgcuuacggugagcuuuuuacguggguuugu

SEQ ID NO: 53617 - RNA, 65 nt, Escherichia coli CFT073
auuuuauggcggaacggcguugcugccaguaauuccacaccaauguugucggucgccauauaagu

SEQ ID NO: 53618 - RNA, 123 nt, Escherichia coli CFT073
cacgcguagccugcgggcuaagcaguaccagcgguuugccuaaaucaugcuguaauaaauggcgugcgugccaggccaguugauuugggcuauggcggacaaaauaguuagcgcgacagcgug

SEQ ID NO: 53619 - RNA, 68 nt, Escherichia coli CFT073
cacggagccgcgcaucaccuguaaugccuggcugaccacgcagcguaaggcgugggaugugcucagug

SEQ ID NO: 53620 - RNA, 55 nt, Escherichia coli CFT073
cagaaagugaugcuuccuccagcuuuugcagcgagagauucagcaucucuuucug

SEQ ID NO: 53621 - RNA, 57 nt, Escherichia coli CFT073
agaucucuucgccaaagugcaguucuuuuugcacauaguuguggugacaguugaucu

SEQ ID NO: 53622 - RNA, 58 nt, Escherichia coli CFT073
agauuggugucaaucauguguugcaggaugccgggauucaggugauugaaaccgaucu

SEQ ID NO: 53623 - RNA, 88 nt, Escherichia coli CFT073
agcaacugauuaugaaucucucagguggaaaucagcaaaaagccauucugggccgcugguuaucggaagagaugaaggucauuuugcu

SEQ ID NO: 53624 - RNA, 55 nt, Escherichia coli CFT073
acugcgaaucgggaauuaucuuugacaacgaugaggauaaaacagauucggcagu

SEQ ID NO: 53625 - RNA, 71 nt, Escherichia coli CFT073
agcgauuccgacuucauggagucgaguugcagacuccaauccggacuacgacgcacuuuaugagguccgcu

SEQ ID NO: 53626 - RNA, 56 nt, Escherichia coli CFT073
agcgcaaauugcgcagguguaaaguuugauacaccaaaaugacgcacuuugccgcu

SEQ ID NO: 53627 - RNA, 112 nt, Escherichia coli CFT073
agccuaccaaucagaagguagcauguguaguaucgcaaacauaaagagaaacugcucaugaauuauguuaucugcacuaccauugucgcccuuggucucauucugacaggcu

SEQ ID NO: 53628 - RNA, 73 nt, Escherichia coli CFT073
agcgccgccaguuugcuggacucugccaguucacuacgcguaauuuguaauacuuguucagcuugacugcgcu

SEQ ID NO: 53629 - RNA, 61 nt, Escherichia coli CFT073
agcgggacguagaagcugacgacguugccaaaucgcugacgggucagacgcugcgcccguu

SEQ ID NO: 53630 - RNA, 61 nt, Escherichia coli CFT073
agccauauugaaggggcgagcaaacaaagugauuuuguucaggcggguuaucaguaugguu

SEQ ID NO: 53631 - RNA, 80 nt, Escherichia coli CFT073
agcugaacaauuauugcccguuuuacagcguuacggcuucgaaacgcucgaaaaacuggcaguuuuagauugauuugguu

SEQ ID NO: 53632 - RNA, 82 nt, Escherichia coli CFT073
aguggaaaauugcacagaggaaagcuguugggacuguaauuauugcauucggcccagcuuuucccucucucguagugccauu

SEQ ID NO: 53633 - RNA, 88 nt, Escherichia coli CFT073
aguguuggcgacaucgacguggugaaaucgccgacaaucucuucgagaauaucuucgaccgucaccagucccugaaugucuccauacu

SEQ ID NO: 53634 - RNA, 110 nt, Escherichia coli CFT073
auacaaccugggggccgauuucucucugccugccgaggccaaagauaaaaaaaucauccuggugccgggucagguagaagacgaugccucaauuaaaacaggcacugugu

SEQ ID NO: 53635 - RNA, 83 nt, Escherichia coli CFT073
aggcagcaaggauuugcgugucaaucaaggguugugguaauucgccaaagacauugaggaacacuuccagaucuucacugccu

SEQ ID NO: 53636 - RNA, 81 nt, Escherichia coli CFT073
acgaccugauucaguugauacugauuuuccugaaucugaccacgcagggaaucaauaucggauugauuaucagagaguugu

SEQ ID NO: 53637 - RNA, 70 nt, Escherichia coli CFT073
acgccuuauccggccuacaaaaucgugcaaauucaauauauugcaagaagaucguaggccugauaagcgu

SEQ ID NO: 53638 - RNA, 83 nt, Escherichia coli CFT073
acgcucgaccgugaaaucacgcugccauccuccgguaccacgcugauaagccugguugacggaaguggcaauccggucagcgu

SEQ ID NO: 53639 - RNA, 60 nt, Escherichia coli CFT073
acgcugcaccggauaaaucaacagcguuucgcuggcgagaucuuccgguguaauacgcgu

SEQ ID NO: 53640 - RNA, 72 nt, Escherichia coli CFT073
accuuuggcuucagcguuuugcaggaaaccacgcaucugauggaaaaccugcucgaugaagccagacgaggu

SEQ ID NO: 53641 - RNA, 68 nt, Escherichia coli CFT073
acggcucgaacgcagugaaagagcacggcuuccaaugccaugucggaucgaugcgcucgccaagccgu

SEQ ID NO: 53642 - RNA, 58 nt, Escherichia coli CFT073
acggcugagagcaccaccagagaacauguuaaacaucucaaugauggugccucgcugu

SEQ ID NO: 53643 - RNA, 106 nt, Escherichia coli CFT073
acguacgcugaaccugacugcucucuaucgcggcguuacgccggugcacuuugauagcgcuaaugacgguguagcagcugccagcgaagcgguuaaucugcugcgu

SEQ ID NO: 53644 - RNA, 68 nt, Escherichia coli CFT073
accccauacagaaagcuuauaaugcgaucugcuucacuaaaguggcauuauuucuuuuuguugguggu

SEQ ID NO: 53645 - RNA, 77 nt, Escherichia coli CFT073
aaucaugagcaucgaaacguucgccuuucagggcaacaaacaggcagcccggcgucaguuuucgcgugucagugguu

SEQ ID NO: 53646 - RNA, 87 nt, Escherichia coli CFT073
acagguucggcagcggcggcgacagggaccucagucaccaucggcugcacuuguacuucuuccuguucgcgcugcucuucaaccugu

SEQ ID NO: 53647 - RNA, 96 nt, Escherichia coli CFT073
acaucaacagcguaucgaagaaaauuuugcuauuugggauuucucacugacagagaaagaaauggcgcaaauuaguucgcuugauuuggguuaugu

SEQ ID NO: 53648 - RNA, 81 nt, Escherichia coli CFT073
aaauacugcucggcgaucuaucagccaacgcccacgaauuuuuuguggccuuggaacgauguauccuaguuuuccguauuu

SEQ ID NO: 53649 - RNA, 75 nt, Escherichia coli CFT073
aacaaauauaaaguuccgcguauugcguucguuaacaaaauggaccgcaugggugcgaacuuccugaaaguuguu

SEQ ID NO: 53650 - RNA, 66 nt, Escherichia coli CFT073
aaaaguggaaacagguuaucccgguguccugauuuugugcuccacuacagaacuuguaucccuuuu

SEQ ID NO: 53651 - RNA, 72 nt, Escherichia coli CFT073
aaaauagucagaagaguaagaucaauauuucguaagguuguaaauauuugugguuuaccuucugacgauuuu

SEQ ID NO: 53652 - RNA, 81 nt, Escherichia coli CFT073
aacgauaccgauauggcaaucaucgacaaacgucguccgcgugcgaacguuucccaggugaugcauaucaucggugacguu

SEQ ID NO: 53653 - RNA, 62 nt, Escherichia coli CFT073
aagcccauaucuugugcuuguggcugaucggugcgaucgccgccugcauucagaugcagcuu

SEQ ID NO: 53654 - RNA, 110 nt, Escherichia coli CFT073
aagcccguacucuggucacgcucuuauuucaucgguucaugugguggagcaccgcuggaaguugugaaaaaguauauucagaaucagcguggcugauaaacugcgggcuu

SEQ ID NO: 53655 - RNA, 94 nt, Escherichia coli CFT073
aagguguugagcccuuuuucuuccagcauguagcggcaaauggcuucgauuucaugcggaggacagccgugcaugguggagaggguaaccccuu

SEQ ID NO: 53656 - RNA, 65 nt, Escherichia coli CFT073
aaguuacaucaacaaacucaggcgccuugcccgacaggagaaugacuuuauugauguacacgcuu

SEQ ID NO: 53657 - RNA, 66 nt, Escherichia coli CFT073
aaguuugccguggcaguggcgauggggacaaugaucuucaccgucggcggugcgacggucgaauuu

SEQ ID NO: 53658 - RNA, 93 nt, Escherichia coli CFT073
aauaacacucgcuucggccucucuugcggucugguuucccccgagcgggaaaaauucgaucaacuguugcugggggcacgggcggggauuguu

SEQ ID NO: 53659 - RNA, 61 nt, Escherichia coli CFT073
gaaagugacggauuuaacgcggcgaguauugaugucgccuucguugaugauggucgcauuc

SEQ ID NO: 53660 - RNA, 76 nt, Escherichia coli CFT073
gaaaaugagcgccgccuguuuuucuucagcgccaaaacgccauuagcccuuagacaacaguuggaugcucauuauc

SEQ ID NO: 53661 - RNA, 69 nt, Escherichia coli CFT073
gaaaccuggauggugcauauuugcggcaucguuuugcuugcuggucgucugaugcauuauuacgguuuu

SEQ ID NO: 53662 - RNA, 130 nt, Escherichia coli CFT073
gaacguugucccucgugccuucgaacguauuggcgguacgguguuggguucgauuuuaggucuuaucgcucugcaacuggaguuaauuucguuaccgcugauguuagucuggugcgcggcggcgauguuu

SEQ ID NO: 53663 - RNA, 55 nt, Escherichia coli CFT073
gaacugguuucgcuuucuuaaagccuucuuuaaaggcgauagaagcagccaguuu

SEQ ID NO: 53664 - RNA, 57 nt, Escherichia coli CFT073
gaaguggcagcgcagcagguuucugaucaacagcuggaaacugcccgcuuccgcuuc

SEQ ID NO: 53665 - RNA, 69 nt, Escherichia coli CFT073
cuguuuacggcuuacggcgcacgaguaaaaaucguuuaucuugaagugccaugggcgcaauggaagcag

SEQ ID NO: 53666 - RNA, 71 nt, Escherichia coli CFT073
cuucaaguugcaugugcugcgacucgaauuauuuagaguuugaaaggguuagcaguauaugagcaccgagg

SEQ ID NO: 53667 - RNA, 73 nt, Escherichia coli CFT073
cuuccgccgucaugauaaaacucacuaaacugucgauacguacaguauaggguuuuuauacagugcacggaag

SEQ ID NO: 53668 - RNA, 62 nt, Escherichia coli CFT073
cuucuucuuuagccgcuucaauauacgaagguggaauagaaagcaggcagcuaaagacaaag

SEQ ID NO: 53669 - RNA, 56 nt, Escherichia coli CFT073
cuucucuucaaucgggauuaucgcgggugcgguuaaaggccugaaugaagagcaag

SEQ ID NO: 53670 - RNA, 82 nt, Escherichia coli CFT073
cuuuguuauuuuguuaagcuuugcacuccauuuaucaauaguauuuugaacgauggugucagguuuaaauugaucugcaaag

SEQ ID NO: 53671 - RNA, 64 nt, Escherichia coli CFT073
gagaaauaccaucaaaaucgugaguguugucagcauuuucaccgguauuuggggcuguuucauc

SEQ ID NO: 53672 - RNA, 71 nt, Escherichia coli CFT073
gagaguugauucaugaaaucgacauguacgcacccgauguggucgugcuggcugguuuuaugcgcauucuc

SEQ ID NO: 53673 - RNA, 80 nt, Escherichia coli CFT073
gagagcgaaggacugaugccuggcagccacuucaaaaguaugcaguuuugauaguugccagccguuaagcagucgauuuc

SEQ ID NO: 53674 - RNA, 56 nt, Escherichia coli CFT073
gacguuuucuccuuuuuugaugcgguacugcaacucaucaaaaggcagauaacguc

SEQ ID NO: 53675 - RNA, 57 nt, Escherichia coli CFT073
gacucuccgcuaucugcugcugauacgccugcgcuauccacaccggacgugagaguc

SEQ ID NO: 53676 - RNA, 97 nt, Escherichia coli CFT073
gacgcauugcguucuguacagcacgcuucauagcacgacggaacauaacgcgacguuccagcugagaagugaugcugucagcaaccaguuuugcguc

SEQ ID NO: 53677 - RNA, 59 nt, Escherichia coli CFT073
gaauaaacacugcacuguguauucauuccaacgagugaauacacggagcaaugucgcuc

SEQ ID NO: 53678 - RNA, 86 nt, Escherichia coli CFT073
gaaucgagauguucugcucuuuagccgcagccaggucugccggagucaggcucaguacgcagcugaagacgaagaacauuacgguc

SEQ ID NO: 53679 - RNA, 77 nt, Escherichia coli CFT073
gacauagaaauauuugcccggcgcguucggaauuucaaaaccgaaauaaggcgcgucgcgggagauaucccacuguu

SEQ ID NO: 53680 - RNA, 76 nt, Escherichia coli CFT073
cugugaucauaaugguacacuuuauaggaauuacagcggggagaauguacuguaacuguugccauauggucuccag

SEQ ID NO: 53681 - RNA, 60 nt, Escherichia coli CFT073
cuguacggcguggugaacccgcguauucgucauaagaaguaaggggacaucaugucacag

SEQ ID NO: 53682 - RNA, 86 nt, Escherichia coli CFT073
cuguuguccuggauauuuauacaucccaauaaagcauguaugccauauccauuuuaugaugugugaaaaguuaguucagguaauag

SEQ ID NO: 53683 - RNA, 60 nt, Escherichia coli CFT073
cuggcgagccacgcauuaagcuguuuuccggcaucagcuucagaguuccggcugcgucag

SEQ ID NO: 53684 - RNA, 78 nt, Escherichia coli CFT073
cugcuggaaaacugucugaaguggauuuuaaagggguuaagcaggcauuagccaaaaugcauuauacgguucuggcgg

SEQ ID NO: 53685 - RNA, 69 nt, Escherichia coli CFT073
cucuuuuccuccagguacggacccgcguauuuccaucaacgugcuggagucugccggacuggaagugag

SEQ ID NO: 53686 - RNA, 83 nt, Escherichia coli CFT073
cugaaaguuaaugauguuuuaagcucugugagcgaauuaaugcuuucgcucauaaucagaucuaaaacgguaauaacuuacag

SEQ ID NO: 53687 - RNA, 72 nt, Escherichia coli CFT073
cguuguuguaaugcggcuuccagcgugauggcacuuaauaacgugguauuauuucugccgcguugcaaaccg

SEQ ID NO: 53688 - RNA, 56 nt, Escherichia coli CFT073
cuccuuuguaacguugcaggaugucgguggccguauucaacuguacguugcaagag

SEQ ID NO: 53689 - RNA, 86 nt, Escherichia coli CFT073
cgugguaugcguuacaccuugaguacccgccgggccgacaacaaagucagguugcgcaggcaggguaaucggggaaggauuccacg

SEQ ID NO: 53690 - RNA, 121 nt, Escherichia coli CFT073
cgugguugggauauuacggcauaguuauucacacucccuucacuuacuccacuuaaauuggcacgcaaagguaaguaaagggaguuugauaugucuguuucacgucggguaauucaucacg

SEQ ID NO: 53691 - RNA, 66 nt, Escherichia coli CFT073
cguuccaucucgguguggauggcggcauugaaguuaccgccagccauaacccgauggauuacaacg

SEQ ID NO: 53692 - RNA, 85 nt, Escherichia coli CFT073
cgugcgggccaaucaucgaggugugcaaagacugauagccguucgcuuuuggaauggcgauauagucuuucacgcggcccggacg

SEQ ID NO: 53693 - RNA, 56 nt, Escherichia coli CFT073
cguacccagguggagacguucuccagcgccuggcgauaagucucuuccuggugacg

SEQ ID NO: 53694 - RNA, 57 nt, Escherichia coli CFT073
cgucacgcugguggaucagggcggacaucuguuaacccaguccaacaccagcgggcg

SEQ ID NO: 53695 - RNA, 57 nt, Escherichia coli CFT073
cgucauccuggugguuuucaccugauaaacgcagcagcugaaaggcgcuggaugacg

SEQ ID NO: 53696 - RNA, 95 nt, Escherichia coli CFT073
cguccguuugccgguuugccggugccaucaagguuugucacgguaauaucacuguuaaauuguuuaaugguauugaccagcaugguaccuggacg

SEQ ID NO: 53697 - RNA, 71 nt, Escherichia coli CFT073
cggaaaccguacagaaaaaguuuggcaucuucggcgaaccgaugaugguuggcacuauucugggcauucug

SEQ ID NO: 53698 - RNA, 62 nt, Escherichia coli CFT073
cggcggcaacguggcaacugcugcaggugcccgcgcgcuggcagaagccgguugcagugccg

SEQ ID NO: 53699 - RNA, 71 nt, Escherichia coli CFT073
cggcugacccagugcuaacaaauguucugccaucgcgaacaauuucucugcacuggcuuuucccucggccg

SEQ ID NO: 53700 - RNA, 62 nt, Escherichia coli CFT073
cgggaaagcaguuccuuuuggcucugucguuacggccagaaacggggggagcaguaucgccg

SEQ ID NO: 53701 - RNA, 78 nt, Escherichia coli CFT073
cgggcguggcaggaucugucuccucauggacucacgcagcuuaucuguucuaagccagaggcgacgccugccgcuucg

SEQ ID NO: 53702 - RNA, 104 nt, Escherichia coli CFT073
cgguaaacaguacgcaucagcgacaugcccugguguuuaucgaucuugaucgcuuuaaagcggugaaugacagcgccgggcaugcggcgggcgacgcuuuacug

SEQ ID NO: 53703 - RNA, 67 nt, Escherichia coli CFT073
cggugauuaucgcuggucugcugccgauucuguggggaacaggagcagggucagaggugaugagccg

SEQ ID NO: 53704 - RNA, 102 nt, Escherichia coli CFT073
cgccgcgcggaguauuuuucuggcgagcuggaaaccuuccugcugauggcgcgcgacgagcaggacgauccgcucaaucugaaagguuccuuugccggggcg

SEQ ID NO: 53705 - RNA, 91 nt, Escherichia coli CFT073
cgccaucugacgcaggcgaauguaauagagcguuuugauacccuugcgccaggcguaaaucugcgcuuuguugauaucgcgagugguggcg

SEQ ID NO: 53706 - RNA, 64 nt, Escherichia coli CFT073
cgaucguggcggaaaauugcugccacacgaguaucgauauguggcauauguucgcgcauggucg

SEQ ID NO: 53707 - RNA, 57 nt, Escherichia coli CFT073
ccugguucgggucgcgcuuguugauauagccagagagcaggcagcgaccggaguagg

SEQ ID NO: 53708 - RNA, 72 nt, Escherichia coli CFT073
ccuuucaauacuuaucgauuccuuugcaaggaucgccaguuccgccacaaagaguugauaaaaaucgacagg

SEQ ID NO: 53709 - RNA, 119 nt, Escherichia coli CFT073
ccugccaauuaaucaggaauccgcagccacuaagcguuuucucgcgggggauauugauaucaccgaauccuucccgaaaaauauguaucagaagcuguugaaggauauuccggggcagg

SEQ ID NO: 53710 - RNA, 75 nt, Escherichia coli CFT073
ccugcgggcauuucgcuugauaaagaucgaucauuuuuuuaaucgucaguuuuucacgagagauacgcuugccgg

SEQ ID NO: 53711 - RNA, 62 nt, Escherichia coli CFT073
ccgcuguugccguccaucaucgacacugccacgucguuggaugcgcagauggcauacagcgg

SEQ ID NO: 53712 - RNA, 80 nt, Escherichia coli CFT073
ccggcuggugaaaaugcucggccucgaaccgggcuuuauuaucugcccguuccgcggcgaguauuuccgccuugcgccgg

SEQ ID NO: 53713 - RNA, 64 nt, Escherichia coli CFT073
ccggggauucuggcggcgguagaccgagagauuuuugguuccucggauaccgaugccgauccgg

SEQ ID NO: 53714 - RNA, 55 nt, Escherichia coli CFT073
ccgacuugcauaagauaaacgaauuguucauuguuuaugcucauuuguaggucgg

SEQ ID NO: 53715 - RNA, 96 nt, Escherichia coli CFT073
gauugccggaugcggcguaaacgccuuauccggccuacaaaagcaauaauuucaacagauuuugcaggccugauaagcguagcgcaucaggcaauc

SEQ ID NO: 53716 - RNA, 63 nt, Escherichia coli CFT073
gauuccgcccgccaguaaaccggacuucacaccuaacaaccacggucugguggugcgcggauc

SEQ ID NO: 53717 - RNA, 65 nt, Escherichia coli CFT073
gcaaauuuuaccucguugguaucaucagugguuuggcgugccaguggauaacggguagaauaugc

SEQ ID NO: 53718 - RNA, 82 nt, Escherichia coli CFT073
gcaagguuaaccacaugaaaaucauuaugguaacauaugaggcuuuccaaaccaccugaucauuuucauugguuaacucggc

SEQ ID NO: 53719 - RNA, 72 nt, Escherichia coli CFT073
gaugauuauguuguugauaucccgcaaaauaccuggaucgaacagccgugggauaugggcgucguauucguc

SEQ ID NO: 53720 - RNA, 58 nt, Escherichia coli CFT073
gaugcguuuaugccaguaugguuuguugaauuuuuauuaaaucuggguuaagcguguc

SEQ ID NO: 53721 - RNA, 56 nt, Escherichia coli CFT073
gcagcagcgccuguucaagcgcagaaaauccauugucugaauccugcgcugucugu

SEQ ID NO: 53722 - RNA, 59 nt, Escherichia coli CFT073
gcaggauaaugaauacagaggggcgaauuaucucuuggccucgcuggucguuauccugc

SEQ ID NO: 53723 - RNA, 76 nt, Escherichia coli CFT073
gcaauuugcgauaggagucugggguaaaguugacgucuucgacacauuucuucccggcuccgaagcgguacauugc

SEQ ID NO: 53724 - RNA, 65 nt, Escherichia coli CFT073
gcacacagggcugaugauguucccaguuuaacggacuucggauccauaacaucggccaugugugc

SEQ ID NO: 53725 - RNA, 56 nt, Escherichia coli CFT073
gcacagaagugguauaugcguucucccuuacgaagccuugcauaauccuucugagc

SEQ ID NO: 53726 - RNA, 75 nt, Escherichia coli CFT073
gcacauaucggcgcucacgcgccguuuaccguaccggaugccggucuggagaugcugcgugaagccgugaaaagc

SEQ ID NO: 53727 - RNA, 56 nt, Escherichia coli CFT073
gcacgggcgacauuuggcaggcuucauucacgccugcuauucccgucagccugagc

SEQ ID NO: 53728 - RNA, 130 nt, Escherichia coli CFT073
gcagacgcuuggcggcguggguugccaccuguaucaggaguuugaaggccauugucugacggcgucgcagcuggagcaggccaucacgaccuugcugcaacgccacccaaugcugcauaucgccuuucgc

SEQ ID NO: 53729 - RNA, 88 nt, Escherichia coli CFT073
gcagaguugcgcgugcaggcgcaguaagggguagcaacaaugagucagaauguuuaucaauuuaucgaccugcagcgcguugauccgc

SEQ ID NO: 53730 - RNA, 87 nt, Escherichia coli CFT073
gcagauccaucuguuaccguuucaucaguacggcgagccgaaauaccgccugcuggggaaaacauggucgaugaaagagguuucugc

SEQ ID NO: 53731 - RNA, 91 nt, Escherichia coli CFT073
gcagaugaaaaccugcauucauggcgaucaggugcuggcucagccgcugggcgcugaccguaaaggucgucgugaagcgcguauuguccgc

SEQ ID NO: 53732 - RNA, 59 nt, Escherichia coli CFT073
gagcgacauugcuccguguauucacucguuggaaugaauacacagugcaguguuuauuc

SEQ ID NO: 53733 - RNA, 73 nt, Escherichia coli CFT073
gauagcccgccgccguagccgcacguugacauaaauuaugaaaacucugcggcauggcgggccacgguuuauu

SEQ ID NO: 53734 - RNA, 55 nt, Escherichia coli CFT073
gauauuuuacgcgcaauaacuguuuggcgcauuaguuguuugagcggaaaauauc

SEQ ID NO: 53735 - RNA, 58 nt, Escherichia coli CFT073
gaugaacuugcgcaccuaaucggcuaaauuguugaauaacagacagugccaguucauc

SEQ ID NO: 53736 - RNA, 81 nt, Escherichia coli CFT073
gccguguuugucgccuauuauguguuggguauacgucagcauaugagcauggggacgaugcucacacauacggaaaauggu

SEQ ID NO: 53737 - RNA, 61 nt, Escherichia coli CFT073
gccgguaauauugccugccggauaacgcaucagacgcgaggcauccucaauauucaccagc

SEQ ID NO: 53738 - RNA, 58 nt, Escherichia coli CFT073
gccggugaaacgcgcgaaauuugcacuuucccaccggcaaaacgugauuuuuacuggc

SEQ ID NO: 53739 - RNA, 90 nt, Escherichia coli CFT073
gccgcuggcgauugaucauuuucgcuauuuugccucguguauucgggcgcaggaaggugggaucagugaaauugauagcgaaaccguggc

SEQ ID NO: 53740 - RNA, 82 nt, Escherichia coli CFT073
gccggacccggcaaacagccccauacgcugcccgcguccgacgguaagcagggcauugauugggcgcacgccgguguccagc

SEQ ID NO: 53741 - RNA, 102 nt, Escherichia coli CFT073
gccggaugcaacgcuggcgcguuuuauccggccuacaaugagcacaacauacugauuuguaugguuuuguaggccggauaaggcguucaagccgcauccggc

SEQ ID NO: 53742 - RNA, 63 nt, Escherichia coli CFT073
gccgagcagcaacgcuggcuggagcaccgccgccaggucuucacgccagaguuuuugcagggc

SEQ ID NO: 53743 - RNA, 58 nt, Escherichia coli CFT073
gccagcuguucggcuaaggauuccagcguuacaggcguuuccuguuccagcagucggc

SEQ ID NO: 53744 - RNA, 59 nt, Escherichia coli CFT073
gccaguuggguaccgauauuucgccgcaacucccuugcgaagaaauugaugccucuggc

SEQ ID NO: 53745 - RNA, 57 nt, Escherichia coli CFT073
gccauauccggcuggcgaauccccgcacggcggagagcgaguccagccugaugcugc

SEQ ID NO: 53746 - RNA, 91 nt, Escherichia coli CFT073
gccagucccgcagucggcgcggaaagggguauuggcauugacguucgucaugcugggauuaaccuucuuuuccgccaguauguggaccggc

SEQ ID NO: 53747 - RNA, 69 nt, Escherichia coli CFT073
gcccagcagacaaacagcgucgaggugacgugaucuuucgaccacuccagcaccuguuugaucugcggc

SEQ ID NO: 53748 - RNA, 64 nt, Escherichia coli CFT073
gcccauaaagugaucuucuaagcccgcacggauaaucuggcggucguuguagagauacuccggc

SEQ ID NO: 53749 - RNA, 63 nt, Escherichia coli CFT073
gccacgcgcaguugcccaaagguacgcguccacuaaugcuaaauuuugaccaacagugcuggc

SEQ ID NO: 53750 - RNA, 79 nt, Escherichia coli CFT073
gcaugcacuuucccugugacaaugauacagucaaaaauaagcuuuaauauuguaucccugauuauucagaaaggcaugu

SEQ ID NO: 53751 - RNA, 63 nt, Escherichia coli CFT073
gcauguacaugcagcugauaaucugaccuuuaaaggaaaacugauuauuccugccuguacugu

SEQ ID NO: 53752 - RNA, 56 nt, Escherichia coli CFT073
gcaguaacacuuccgcacugaccaguuuaccgcuggucaucucgaccuguggcugu

SEQ ID NO: 53753 - RNA, 79 nt, Escherichia coli CFT073
gcauaauugaagggauguuaauggcauuagauauccgguuagauauggauaucguugcuaauaauucuaauugauaugc

SEQ ID NO: 53754 - RNA, 76 nt, Escherichia coli CFT073
gcauccgaauucguuuauuuucgaacguauacauacaaauauguacaauaauaagcgaaauaauuuuuggauaugc

SEQ ID NO: 53755 - RNA, 60 nt, Escherichia coli CFT073
gcuugaugaugagcgucgcgggcugcuugccagccgcuuaaaagcgacgcaaucacaggu

SEQ ID NO: 53756 - RNA, 85 nt, Escherichia coli CFT073
gcuuuugcugugcuaguuugcuuucaaaaugaaaguaaagauucucuuucuucauuuuguaaggcgaacgaccaauaacaggagc

SEQ ID NO: 53757 - RNA, 64 nt, Escherichia coli CFT073
ggaaaacgugcugcugcauaagcugccggugaaacgccugcaacuggcugauggcagcaccgcc

SEQ ID NO: 53758 - RNA, 60 nt, Escherichia coli CFT073
gcugguuaagcguauuagccaacguaagaaagagauguuggcggcugaagcuuaauuagu

SEQ ID NO: 53759 - RNA, 123 nt, Escherichia coli CFT073
gcuguuaagucaguacgccgguucuaccugcgaacuggauagccaggcaggguuguauaacccagguaugcaauggcuggcauccggcgugcuggaaugggugagaaaacuguucuggacggc

SEQ ID NO: 53760 - RNA, 71 nt, Escherichia coli CFT073
gcuguucuacacgcgcugcuucaacauuguaggcaauacgcuccacagggcuguagcaugcgucgaccagc

SEQ ID NO: 53761 - RNA, 68 nt, Escherichia coli CFT073
ggaagucauugagcccgagaucagugaucgacacuccgguuuucaggucuuccagcucaaucacuucc

SEQ ID NO: 53762 - RNA, 70 nt, Escherichia coli CFT073
ggaaguuacguugauauuguggucaagcgcgguaaccgcgugcgcuccaacguuaaccuguacgacuucc

SEQ ID NO: 53763 - RNA, 56 nt, Escherichia coli CFT073
ggaaguugaugaucauaugcucgccgcgcugggcugcauggcuguuaucaucuucc

SEQ ID NO: 53764 - RNA, 69 nt, Escherichia coli CFT073
gcugguauuuucaaucgguacgacggcauagucggccuggccgguuuccaccugauuaaaaauaucggc

SEQ ID NO: 53765 - RNA, 56 nt, Escherichia coli CFT073
gcuggguuggggagaaauaagccacucugaaauggagcgauuucugcucauccagc

SEQ ID NO: 53766 - RNA, 65 nt, Escherichia coli CFT073
gcugggcuggaacuacugguacaacugggcggugacuauugccguugaccugguugcagcacagc

SEQ ID NO: 53767 - RNA, 65 nt, Escherichia coli CFT073
gcugggggacguauagacucaacuccuuacaaagaaaauguagggcugcuugcuguucuccaugc

SEQ ID NO: 53768 - RNA, 73 nt, Escherichia coli CFT073
gcuggccaguuucuccugcaaugacaaaccacuccaggcccagguuguucccgcaggaagacuguuugccagu

SEQ ID NO: 53769 - RNA, 130 nt, Escherichia coli CFT073
gcuggaagaggcguuacgcuuaggggcagacguuguuggggcgauuccgcauuuugaauuuacccgugaauauggcguggagucgcugcauaaaaccuucgcccuggcgcaaaaauacgaccgucucauc

SEQ ID NO: 53770 - RNA, 62 nt, Escherichia coli CFT073
gcugacgagguuucaugggcgugauuaccugauuuagguuucaaaaugauaacuucgcaagc

SEQ ID NO: 53771 - RNA, 82 nt, Escherichia coli CFT073
gcugacguugcggggagcgggagaaauggacguauccugaaagaggauguacagcgcguuacuccugcaccagucauucagc

SEQ ID NO: 53772 - RNA, 57 nt, Escherichia coli CFT073
gcucuaacgccagcugcgaaguggaguuucaggaugccauuggcugguuguuggggc

SEQ ID NO: 53773 - RNA, 65 nt, Escherichia coli CFT073
gcucuucaaaaccggcuuuuugcaaugcaucacgcauuacgucaauuucagccgguuuuucgagc

SEQ ID NO: 53774 - RNA, 74 nt, Escherichia coli CFT073
gcuccaucgccagcaucgugucuucauagcccugcugacgccaggugucgauaugugccgauguaaaacugagc

SEQ ID NO: 53775 - RNA, 86 nt, Escherichia coli CFT073
gcguuauugaggcugcgcagcagucgccaguuuauaaaauggcgauggaauggaaacuggcgcugccgcugcauccggaauaucgc

SEQ ID NO: 53776 - RNA, 76 nt, Escherichia coli CFT073
gcguuccggucugacauaagggcacugcugaccgugcuccgucagcccgucgucaguguguucaaaccagggacgc

SEQ ID NO: 53777 - RNA, 59 nt, Escherichia coli CFT073
gcguagcggguuugcuuacacccuccgguuaaggaauguacaaucaaaccaguugacgc

SEQ ID NO: 53778 - RNA, 56 nt, Escherichia coli CFT073
gcgggcgaggcgcauagacguugcguaacgcuucaauuucaaucgcgucgcccagc

SEQ ID NO: 53779 - RNA, 77 nt, Escherichia coli CFT073
gcgggcgguauuauuucugcggcagguuuuaccugguuugcaaaggaggaaccgcccgcagaaaaaacgucgaccgc

SEQ ID NO: 53780 - RNA, 74 nt, Escherichia coli CFT073
gcggcaauucugaacuacagccguagccuggcaaaacaggucgcggagaaagguauucgggugaauauugucgc

SEQ ID NO: 53781 - RNA, 64 nt, Escherichia coli CFT073
gcgcguaucagcccgugggccagggaugaacuggcgaucaaaccuggccuguggcuguaugcgc

SEQ ID NO: 53782 - RNA, 110 nt, Escherichia coli CFT073
gcgcuguauuuauugcauuuggauauuaaauaugaaaaguuaugaugauuaucaacaugauucuucuuaugguuuuauaugggauaagguaaaugccagauuuauggcgu

SEQ ID NO: 53783 - RNA, 82 nt, Escherichia coli CFT073
gcgccacugagcacgcuauuaaacuggcccagcaagagggucucgguuuuguuagcguuaaaaacacgucucacuguggugc

SEQ ID NO: 53784 - RNA, 61 nt, Escherichia coli CFT073
gcgauuggcgcucacccgaguuuucccgacagggaaaauuuuggucgcagcgccaugcagc

SEQ ID NO: 53785 - RNA, 63 nt, Escherichia coli CFT073
gcgauuuaucuugccgaaugcgcuguuaacgccucauccgcguuggcaugguaagcgaagcgc

SEQ ID NO: 53786 - RNA, 105 nt, Escherichia coli CFT073
gcgcaccgcccggguucagcccuugauaaauuuuauccaguaacgccuggcgcucggaagguuccaggaauugcaggguaaaauucagcaccaccaucgaugcgu

SEQ ID NO: 53787 - RNA, 66 nt, Escherichia coli CFT073
gccuguaauuaaaaccuggcucauauugccuccccccgguauguguacucauguuuaacuauaggu

SEQ ID NO: 53788 - RNA, 77 nt, Escherichia coli CFT073
gccugugaaagccugcgcgcuggcgaauccgauauggcgguugccggcggcguggcgcucucuuucccccagcaggc

SEQ ID NO: 53789 - RNA, 102 nt, Escherichia coli CFT073
gccuucaugagcaaugaaacuuucaucccccgugguccgccaguauugaauaaccgcccaggcgauaucggccaccagaugauguuccgccugcgcagaggc

SEQ ID NO: 53790 - RNA, 66 nt, Escherichia coli CFT073
gcgaaaaguaaaagugcgcaguuauggcaucaguuuaaucuggcucgucagcagccuuuuacucgc

SEQ ID NO: 53791 - RNA, 78 nt, Escherichia coli CFT073
gcgaaaauugugauuauggaugaaccgacuucuucguuaaccgaaaaagaggucaaucaucuguucacuauuauucgu

SEQ ID NO: 53792 - RNA, 103 nt, Escherichia coli CFT073
gcgaaggccgcugcgaauaauguuuucaauuucauauucauguuaagcgagauuuugugccuggcaggccauuggguugagaauauuagaguauuggaagcgc

SEQ ID NO: 53793 - RNA, 64 nt, Escherichia coli CFT073
gcgauagcagcgugcuugucccugucucuugugggaacagggcuugcuaaugcugaugauucgc

SEQ ID NO: 53794 - RNA, 111 nt, Escherichia coli CFT073
uaaagcucaaaagaugcgaauauuggauggcggcacaaaagcagaugaaacggguugugccgcuucuucugguuauuaugccugcauguucaaucgcgggaaugcgcuuua

SEQ ID NO: 53795 - RNA, 62 nt, Escherichia coli CFT073
uaaucacaguagucgaaguuuuuuagccgcuuaacuuacugaaauuuaacuacugaugauug

SEQ ID NO: 53796 - RNA, 76 nt, Escherichia coli CFT073
uacuacuacaacaccgacaauuuuuccuuuaucuuuuauacuuguagagaggaagaaucccgguguauucguagug

SEQ ID NO: 53797 - RNA, 56 nt, Escherichia coli CFT073
guuggugcguuuguugaggaugucaugcacauccuucggcaauuccacgcuccagc

SEQ ID NO: 53798 - RNA, 110 nt, Escherichia coli CFT073
guuucucgcuuuggugaugaaggugaauaccgcgugccugcggcaaaaaugcuggcgauggugcugcauggcaugcagggaacgccguauaucuaccagggcgaagagau

SEQ ID NO: 53799 - RNA, 62 nt, Escherichia coli CFT073
guuuccauauugucuuccagaucagcggcaaacgacgccgaacugaauaccaaugaggagac

SEQ ID NO: 53800 - RNA, 60 nt, Escherichia coli CFT073
guuuuccuuauuguggcaauuggccuuguuggucugaucaugcugcagcaagguaaaggc

SEQ ID NO: 53801 - RNA, 68 nt, Escherichia coli CFT073
uagcaugugauucaauguaagcccgggccgucuguuccaguacaccaggcucagcguuguauguguua

SEQ ID NO: 53802 - RNA, 64 nt, Escherichia coli CFT073
uagcggacgucgacuacuggaaacuucgcuaaaacccuguggcaaccagguuggcguccagcug

SEQ ID NO: 53803 - RNA, 68 nt, Escherichia coli CFT073
uacuguguauucguaagcaucauuucugcgcagucuggcagauccugaaauccuuaugaaacaaagua

SEQ ID NO: 53804 - RNA, 67 nt, Escherichia coli CFT073
uagggcugguggaggcgggacuggggauuucggcgcuuccuggucuggcaaugccccaugcgcccua

SEQ ID NO: 53805 - RNA, 90 nt, Escherichia coli CFT073
ucacauaguauuugcgccaaaauaccgaagacagguguucuacagagagaagcguagagcaauaggcuguauuuugagaaagcuguguga

SEQ ID NO: 53806 - RNA, 100 nt, Escherichia coli CFT073
ucacccacaguuguuuucaguuccuuauaauauucaaugaauugccuuuguuucucuucacugaauuuaugggggacgccugacgguuuuuuguagguga

SEQ ID NO: 53807 - RNA, 61 nt, Escherichia coli CFT073
ucaaacucccuuuacuuaccuuugcgugccaauuuaaguggaguaagugaagggaguguga

SEQ ID NO: 53808 - RNA, 56 nt, Escherichia coli CFT073
uaugcauaaaaagcagcggcugacgucuuccgacguuggccguuuuuuuaugugua

SEQ ID NO: 53809 - RNA, 67 nt, Escherichia coli CFT073
uaugugaagagcguucaagcgccguuacugaaaaauauucugcaaagcggcgaacguaucgugcgug

SEQ ID NO: 53810 - RNA, 58 nt, Escherichia coli CFT073
uauucccauaaacucagaucuauugaugugccacuuaggaucugaguuuuugggaaug

SEQ ID NO: 53811 - RNA, 84 nt, Escherichia coli CFT073
uauucgcuuaaucuauuaauuugcuggaaauauuuaagggaugaaugccuugaauaaaccaucaugauuuuuagacaguggaug

SEQ ID NO: 53812 - RNA, 62 nt, Escherichia coli CFT073
uauugccaugagcuauuaagaugucauuccuauaaaaaggagaacaauagccaugugcaaua

SEQ ID NO: 53813 - RNA, 130 nt, Escherichia coli CFT073
uauuucgcgauacugauugccgcuuucggcuuauuuuugguguugcagccguggcaacucgauuucucuucgaugaaaagugccaugcuggcaauccucuccggugugaguuggggggcgagcgcgauug

SEQ ID NO: 53814 - RNA, 85 nt, Escherichia coli CFT073
uauuuguacgaugucgguccuuaucugauuuccagugaugaauguauucagguaaaggaguucgagaaaaauuauugugcagaua

SEQ ID NO: 53815 - RNA, 82 nt, Escherichia coli CFT073
ucuaaaguaaauugccguuguagugccuugucuuugcugauaugcaauucauugcuacuuaacagcccguuaacuuuguaga

SEQ ID NO: 53816 - RNA, 85 nt, Escherichia coli CFT073
ucgucgauugagacaugaagcagguauggcccaucacuguucagcauggugucgagugccgcuucaaccuggucuuuauggguga

SEQ ID NO: 53817 - RNA, 56 nt, Escherichia coli CFT073
ucgcgaguccguuccuguaagguagcuauaugauuuuuauagagcgaggccaguga

SEQ ID NO: 53818 - RNA, 88 nt, Escherichia coli CFT073
ucgcggcaccgauuaugggcaaaaauggcccggaagagauugaugccacggcagaagauuacgagcgcguuauugccuggugccauga

SEQ ID NO: 53819 - RNA, 61 nt, Escherichia coli CFT073
ucgcugauggcgcagguagcgccucgcagggaggcgaaggugcgaugcucgccgucaauga

SEQ ID NO: 53820 - RNA, 84 nt, Escherichia coli CFT073
ucggcaacuugcugcucggcgugccguuugcuuucacaccgcaauuacgcguggaauaucucggcagcuucuggcaacugcuga

SEQ ID NO: 53821 - RNA, 60 nt, Escherichia coli CFT073
ucgaugggcguuaucuuuaucacucacgauaugggcgugguggcagagauugccgaucgg

SEQ ID NO: 53822 - RNA, 61 nt, Escherichia coli CFT073
uccuccuuucagagugcuccgcuucucacuauuaucucacgcaguauucuuaagggaagga

SEQ ID NO: 53823 - RNA, 60 nt, Escherichia coli CFT073
uccagaauucagguugcauccgucugaauggaaugaagauggaaggaucuggauucugga

SEQ ID NO: 53824 - RNA, 68 nt, Escherichia coli CFT073
ucagccacugaccgcugagcaaaaccguauucuggaagcacagcuacgcacucagcgugaguugcuga

SEQ ID NO: 53825 - RNA, 56 nt, Escherichia coli CFT073
ucagaauauccggugaagugauuaauauuucguugaauauuucuccggauuuuuga

SEQ ID NO: 53826 - RNA, 56 nt, Escherichia coli CFT073
ucaggaugccgaaguggaugaugcgaaauacggcuucgucgccuccggcauguuga

SEQ ID NO: 53827 - RNA, 85 nt, Escherichia coli CFT073
ucaggcaguuagcgggcugcggguugcaguccuuaccgguagauggaaauauuucuggagaguaauacccagucuguuucucuga

SEQ ID NO: 53828 - RNA, 55 nt, Escherichia coli CFT073
ucaggucacgcucuggaacagcgucccggcgcuguucgauaugcugcugaccugg

SEQ ID NO: 53829 - RNA, 56 nt, Escherichia coli CFT073
ucaguugggcugcgaaguuuucggucugcaagguccggauaucgacgccgaacuga

SEQ ID NO: 53830 - RNA, 58 nt, Escherichia coli CFT073
ucaguuuuucuccugaucaugaacgaauuaaccauuugaugaaucagagaaaaaguga

SEQ ID NO: 53831 - RNA, 68 nt, Escherichia coli CFT073
ucaucauucuggcgguaaggcggugcuagcccauccugggcgguacaaucuuagugcuaaauggcuga

SEQ ID NO: 53832 - RNA, 88 nt, Escherichia coli CFT073
ucauggauggcgaacuauguggugaaagguuuuggucucgauggcuugccaucauuagccaucuucgcgauucucgccgcuuucuuga

SEQ ID NO: 53833 - RNA, 73 nt, Escherichia coli CFT073
ugaaaaaaaucuccuugacaauuuauuucuggcucaugaagcuggacaugaaaaagcaugggggcuuuuuuua

SEQ ID NO: 53834 - RNA, 67 nt, Escherichia coli CFT073
ugaaaaacggcugcggaauuagaccaguuaucucccgaagaaggaaauuuccgcagcgcguguuuua

SEQ ID NO: 53835 - RNA, 75 nt, Escherichia coli CFT073
ucugauuccggguccaggagcaucauuacgcgcuggcgcugguaaucaugcaucaggaagaaccacagaaucgga

SEQ ID NO: 53836 - RNA, 62 nt, Escherichia coli CFT073
ucuggcggcacucucugucccuuuuucugccgcauuacgucagggauuagagaccugucaga

SEQ ID NO: 53837 - RNA, 58 nt, Escherichia coli CFT073
ucuuacggucgauuucaacagaggcuuuuuucaggccauugaugaauuugcuguaaga

SEQ ID NO: 53838 - RNA, 79 nt, Escherichia coli CFT073
ugauaugccauugaaauuaagaaagccgugcaggcaaguuuuccauuugccaucuacgcuuaauuuugaagguguauca

SEQ ID NO: 53839 - RNA, 90 nt, Escherichia coli CFT073
ugaucgcggaagauuuuacuggcgaugaaguacacggcacuuuucccccagccggugcgcuguacaaccaguaguuuucgccgcugauua

SEQ ID NO: 53840 - RNA, 83 nt, Escherichia coli CFT073
ugaugccaaagaauuagcugacccagcguuuaaugcgcaaaaacaggcgcugaaauggggucuggcugguuuuuccagcacca

SEQ ID NO: 53841 - RNA, 84 nt, Escherichia coli CFT073
uggcaaucgggggaacugggaggccaguggcaagaaaguaaaucacuuuuuuaccacuggccuucugcuuucagacgcuuguua

SEQ ID NO: 53842 - RNA, 65 nt, Escherichia coli CFT073
uggcaacgcugcgguuuugugcuggugcgaauggguaaucaucgugaagccagcagcgguugcua

SEQ ID NO: 53843 - RNA, 87 nt, Escherichia coli CFT073
uggaucgcuugacuccaggcaaacgccaguaaaaauccgcgcuaugaagcaguuuuuacuggcauuugccugaaaagauucgauuca

SEQ ID NO: 53844 - RNA, 69 nt, Escherichia coli CFT073
ugcgcugcuaucuggugagagugucgguaucgugagaacaccgccgcuccguuaucgggugguuucgca

SEQ ID NO: 53845 - RNA, 71 nt, Escherichia coli CFT073
ugcugauguguucugggaucugcaggacacggcaacagaugcaggucugcuuaaccagaacgacguuacca

SEQ ID NO: 53846 - RNA, 75 nt, Escherichia coli CFT073
ugcugccgcaaaacugaugcagaaugcagaaaaugucagcgaauaucugucauuacgccaucaggggcugcagca

SEQ ID NO: 53847 - RNA, 56 nt, Escherichia coli CFT073
ugccuggaacgacgauaacugaguagaccaucgccagaaacguuguuaacccggca

SEQ ID NO: 53848 - RNA, 70 nt, Escherichia coli CFT073
ugcccuugcucauauagauaauuuacugcaucaaaugcggcggucagauugucuauaugaacuguaggua

SEQ ID NO: 53849 - RNA, 72 nt, Escherichia coli CFT073
ugccguagacuucggacauuuucgccaccaccgguuugaaggugcuggucaggaugccggacccugccugca

SEQ ID NO: 53850 - RNA, 84 nt, Escherichia coli CFT073
ugccguccuccaguugcaguuugucggucaucaacauacgcacuucguacgcgaggacuuuauuaaacugcuggaggcucggca

SEQ ID NO: 53851 - RNA, 58 nt, Escherichia coli CFT073
ugcaacaucugucaguacuucuggugcuucuauuuuagaggcagcugucaggugugcg

SEQ ID NO: 53852 - RNA, 61 nt, Escherichia coli CFT073
ugcagauccuucacuuaauuucauucaguuagauccugaaauaauguuguaugagggagca

SEQ ID NO: 53853 - RNA, 57 nt, Escherichia coli CFT073
ugcagcaugucaucugcauuuucugcaggcacaccugaaaaugucaaugacacugua

SEQ ID NO: 53854 - RNA, 58 nt, Escherichia coli CFT073
ugccaggcccaacccuuucauauuaaugaagguggcaaaauuugggacaaaaauggca

SEQ ID NO: 53855 - RNA, 72 nt, Escherichia coli CFT073
ugucugccgcucacguucgugccugcuaccaacuggugaaagagcaugaucgcgugggccgaauggcggaca

SEQ ID NO: 53856 - RNA, 130 nt, Escherichia coli CFT073
ugugucgaauuagaagggcagaguggaaccaccguggccuuuuccgguauagcggcagcagaaccguugcgauuuaucugggaagugccuggcggugggcgguuaauuccgccgcuaaagauucaacgga

SEQ ID NO: 53857 - RNA, 78 nt, Escherichia coli CFT073
uguggcuaaaagcaggcacauaacagcuaaguauuuucaaccagagagaauccuuagcguuguggugaaugcggcuca

SEQ ID NO: 53858 - RNA, 78 nt, Escherichia coli CFT073
uguucauuguaaauuuccucuuugcuaacgcaaaucauuaucauuacgccuuuggcaaagggaaauuuaugaagaaca

SEQ ID NO: 53859 - RNA, 60 nt, Escherichia coli CFT073
uggcgaaucagcgauuuuugcugacuuaaugaacgugcaguaucaauagugauaucgcca

SEQ ID NO: 53860 - RNA, 60 nt, Escherichia coli CFT073
uggcgaucgccacgaucucuccacucaagccuaucaggguggaggacgagguauugacca

SEQ ID NO: 53861 - RNA, 74 nt, Escherichia coli CFT073
uguuuguaccaccgaaaagugauauuacggucucgucgccagugacguuggcuggugaaauuacuuaucaaaca

SEQ ID NO: 53862 - RNA, 84 nt, Escherichia coli CFT073
uuauucuccaguguuauauacuauagggggguaugcauugacauauagcauaccccccuauaguauauugcaugcagaugauga

SEQ ID NO: 53863 - RNA, 66 nt, Escherichia coli CFT073
uuccggcauccgcgauaauaauggacggcaccaugccggugccaucacgucgauuaucgccugggg

SEQ ID NO: 53864 - RNA, 65 nt, Escherichia coli CFT073
uucgagaagugggcucgccaggaaggaauugaauguuaccgccuguaugacgccgaucugccgga

SEQ ID NO: 53865 - RNA, 101 nt, Escherichia coli CFT073
uucgguuucaacaguaaaauggcgcaauuuagcggguuggcgacggggcugcgguggcugccagcuacuuugugucaguacuugcuccagaccaaaccgaa

SEQ ID NO: 53866 - RNA, 63 nt, Escherichia coli CFT073
uucugccugggaagauguaagccgccagcuuuuuguuggcguacucuuuuuccagcgccagga

SEQ ID NO: 53867 - RNA, 74 nt, Escherichia coli CFT073
uucuucgagacaccuucccgaaauuuugcaacguccugcaacggcguaaauaguccggaagaugcgccgaagaa

SEQ ID NO: 53868 - RNA, 108 nt, Escherichia coli CFT073
gguuuugaauaaacgcuuuacuauucucaugaaaacaguguuauguuguuauuuuaacaaccccgcauuguuuuuugaugggauggguauuaagacuuuagagaaacu

SEQ ID NO: 53869 - RNA, 62 nt, Escherichia coli CFT073
guaaaucgcuacauguuaacacacaacguaaauguugugguguaagcacaguaguagaggac

SEQ ID NO: 53870 - RNA, 57 nt, Escherichia coli CFT073
guaaugcuuugaauuucaguuucugggcgaugccguuaagcugcaucagggcgauau

SEQ ID NO: 53871 - RNA, 61 nt, Escherichia coli CFT073
guauugccggcuucgagaaaguggauaugacuguugguagcgaucugaaagcugacaaugc

SEQ ID NO: 53872 - RNA, 65 nt, Escherichia coli CFT073
guauuuccguacgucauaacccagaguucaccaugauggaacucuauauggcuuacgcagauuac

SEQ ID NO: 53873 - RNA, 87 nt, Escherichia coli CFT073
guauuuccugaaagaaaaaguggcggagaucccggaacugcaugcgguuucugaauucauccacuuugccuguacuucggaagauau

SEQ ID NO: 53874 - RNA, 59 nt, Escherichia coli CFT073
gucaggaaauugugucagcgaauugccgagaaauaugcgcaaugcugcgauaucgugac

SEQ ID NO: 53875 - RNA, 65 nt, Escherichia coli CFT073
gucacuaauuagccaucgauaaaaaugguugaguaaccauuuuuggauggucucauuauccuggc

SEQ ID NO: 53876 - RNA, 80 nt, Escherichia coli CFT073
gucgaauuuggcguuagcccggcaggcguguggcguaaccgaucacacgauccgcucgguuccgauacccgaggcgcggc

SEQ ID NO: 53877 - RNA, 63 nt, Escherichia coli CFT073
gguguuuuucagaaagaaugugaugaagugaaaaauuugcaucacaaaccugaaaagaaaucc

SEQ ID NO: 53878 - RNA, 61 nt, Escherichia coli CFT073
gguucacuggugguuuuacuggcgcucuacccguggguggaagugaaauccaacaguagcc

SEQ ID NO: 53879 - RNA, 60 nt, Escherichia coli CFT073
gguucuccggucaccaccgucgacaccgccaagucgggcaaucuggugaacuggaaagcc

SEQ ID NO: 53880 - RNA, 97 nt, Escherichia coli CFT073
ggugaaugcugaauuaaaacgcagaauuuuguccgauagugguaucgguguaccauucgcgcagacgaaaauucuuaaccuuaaucuggaauacgcc

SEQ ID NO: 53881 - RNA, 63 nt, Escherichia coli CFT073
ggugagaaugugguggccaucaccaguucauuucguugagcccugacggccccgacauccauc

SEQ ID NO: 53882 - RNA, 90 nt, Escherichia coli CFT073
ggucuggcgcagcguauuaucaacggcgaagugcccgaaggguugaaaggccgccgcguacuggcgcuggauaugggcgcgcugguggcu

SEQ ID NO: 53883 - RNA, 64 nt, Escherichia coli CFT073
guuccuguuuauaaaaggagagguggaaggauuauagccaucgaugccuugucaggauaggaau

SEQ ID NO: 53884 - RNA, 63 nt, Escherichia coli CFT073
guucuucugccgggagcacaucgguuuuccacgcaucgaagacaauauccugggaggcagagc

SEQ ID NO: 53885 - RNA, 61 nt, Escherichia coli CFT073
guugauggcgcaaaaccgaacgccgcaagcagaugcuuuuuuucuggauuuugccaucaau

SEQ ID NO: 53886 - RNA, 74 nt, Escherichia coli CFT073
guguuucuucaaucugacgcaucaggccaugaauacccgcagccauccccugauggaucagacugagauccggc

SEQ ID NO: 53887 - RNA, 72 nt, Escherichia coli CFT073
guuaaccaaugaaaaugaucaggugguuuggaaagccucauauguuaccauaaugauuuucaugugguuaac

SEQ ID NO: 53888 - RNA, 56 nt, Escherichia coli CFT073
guggauugcacagguuaauacagagaaaaacauucucaguuugcuucugcauccac

SEQ ID NO: 53889 - RNA, 65 nt, Escherichia coli CFT073
guggcucagccacugacgccaggcaucgaccugcugccaggaggcuucgcgaucguggcugccgc

SEQ ID NO: 53890 - RNA, 79 nt, Escherichia coli CFT073
guggcuuugguaaucgggucaccaaauaugaacaacguuuuuguaauucagaauuuggcgaucugaaacugagcgccgc

SEQ ID NO: 53891 - RNA, 87 nt, Escherichia coli CFT073
guguaagguuuacagcgauuuagaccucuaucucgguguucaggcgaucaacuggacagagauguuuaauccuggcgcgaccuucgc

SEQ ID NO: 53892 - RNA, 90 nt, Escherichia coli CFT073
gugcgauaaaguccuaugccaucaauacggcugcccaguuuuucuucauguuccgggcuuaaaccggcauugagcauaacuuuaaugcgc

SEQ ID NO: 53893 - RNA, 90 nt, Escherichia coli CFT073
gugcuugccgaagagaugucauuacugaugcuggacagccgccgggugauccaaagcauucaguugaugaaaucgcugggcggcggguau

SEQ ID NO: 53894 - RNA, 78 nt, Escherichia coli CFT073
gucuuuuuuggcgauagugauguggaacgagucgaucucucuuaucacgagaguuuacaacgcauuguuaaaggcgau

SEQ ID NO: 53895 - RNA, 87 nt, Escherichia coli CFT073
gugaccgaacugcugaaacagaaacaguaugcgccgauguccguagcgcaacagucucugguucuguucgcagcagaacgugguuac

SEQ ID NO: 53896 - RNA, 68 nt, Escherichia coli CFT073
gugaugaccgguuuccgcguagcgcuagcuggcgcacaggauuauuacgguguggaaccggaucucac

SEQ ID NO: 53897 - RNA, 70 nt, Escherichia coli CFT073
gugauggcaauugccgguucgcuggugaguaaaaagagccaacccgccagcuccggcacauugccaacgc

SEQ ID NO: 53898 - RNA, 60 nt, Escherichia coli CFT073
gucguuuuaaauaucacccuguuugccagcgacuauuuuacuggcgaugguauuaacgac

SEQ ID NO: 53899 - RNA, 99 nt, Escherichia coli CFT073
gggcgggcaacggcaucuggaucgcccgguuuuugauucaaugaaagaagcgaugcgacaaacugaggcugaugccagcgugauuuaugugccugcacc

SEQ ID NO: 53900 - RNA, 66 nt, Escherichia coli CFT073
gggcgggcagcauguuaacaggcgguacuuucugguuugucaccggacuguuuauucuguuugccc

SEQ ID NO: 53901 - RNA, 92 nt, Escherichia coli CFT073
gggcugguguuugguaucguugggcugguguugcuacugguucaggcgguggaucucaaugccagcgccacggcgauaaccaguuacagccu

SEQ ID NO: 53902 - RNA, 71 nt, Escherichia coli CFT073
ggguaagcagggcgcgaaugacagcagugcaacauugccacaguucugccaugucgcgcucugcccagccu

SEQ ID NO: 53903 - RNA, 71 nt, Escherichia coli CFT073
ggguuauagagcagguuguugaugacgauauucaccuggcguuccacgccaucauucaccuguuguaacuc

SEQ ID NO: 53904 - RNA, 61 nt, Escherichia coli CFT073
gguauucgcuuugcuuuuacgaucaugaacagcauagagaauaaagggcagggcaaguacc

SEQ ID NO: 53905 - RNA, 58 nt, Escherichia coli CFT073
ggucaguaugugcggcgaaauggcuggagauauccagcaaacagcacgacugcucacc

SEQ ID NO: 53906 - RNA, 81 nt, Escherichia coli CFT073
ggcgggaguuucacguaaaucgacgcgacuggcugaguacgcccgcgccaagucgagcaacguuuuacgacagcacuugcc

SEQ ID NO: 53907 - RNA, 110 nt, Escherichia coli CFT073
ggcucaucacccacaguuguuuucaguuccuuauaguauucaaugaauugccuuuguuucucuucacugaauuuaugggggacgccugacgguuuuuuguaggugacacc

SEQ ID NO: 53908 - RNA, 92 nt, Escherichia coli CFT073
ggcugacagcuacagcaagaaugucaucacccgcguuaucggcgaacagcagaugaaagagcuggggaugcauuccuaucuggcggucgguc

SEQ ID NO: 53909 - RNA, 82 nt, Escherichia coli CFT073
ggcuggagcuggcgguaaucuccagcagcgaugaaacaaaaguaaaagcugacuggccaacgguuacgguugucucugagcc

SEQ ID NO: 53910 - RNA, 97 nt, Escherichia coli CFT073
gggauggcgcgcgcauugagcaguuugaucgcaaagguauggugaacaacaaguucaacuacuucauuaugagcaaacuggcugaagcggguauccc

SEQ ID NO: 53911 - RNA, 84 nt, Escherichia coli CFT073
ggcgcguaugcgcacauucgucggcaguucaaaaucucuaucgguaagauggaagggauugaagagccgcuggcgcguauugcc

SEQ ID NO: 53912 - RNA, 85 nt, Escherichia coli CFT073
ggcgcaacacgcgcgauuccgguaggcggucguuauaccuuccgggauauggggauguuaagcuggaguugcguuguugccagcc

SEQ ID NO: 53913 - RNA, 129 nt, Escherichia coli CFT073
ggcgcaacccgucgcuuacguuauucacggggaaaaccacgcagagcuggcccgacagauggcgcacaaacacgccugcuugcgucauguucuggucgcuggagagaccgugagcgacgauuuuacgcc

SEQ ID NO: 53914 - RNA, 75 nt, Escherichia coli CFT073
ggccugagaaacuuugucgcguggacccaguuccauauauuuguuuuucggcucgcccagcggaguuuccgggcc

SEQ ID NO: 53915 - RNA, 55 nt, Escherichia coli CFT073
ggcgacauugaaaauaaauauccuccggcauagccggagguuuuucaaaugcgcc

SEQ ID NO: 53916 - RNA, 91 nt, Escherichia coli CFT073
ggccggaaccuucuaugauuaugaggcgaaguaucucucugaugagacacaguauuucugccccgcaggucuggaagcguuacaagaggcc

SEQ ID NO: 53917 - RNA, 85 nt, Escherichia coli CFT073
ggccauucugggauacugguugcucauugcaggcguaacuuuacgcauucuaaugaaacgacgcgcaguucccuccgcgauggcc

SEQ ID NO: 53918 - RNA, 119 nt, Escherichia coli CFT073
ggcccaucuuguacucaaaugcuggccugguuuggcgcugacgucauuaaaauugaacgucccagcguuggugacguaacgcgccaccagcugcgagauauuccugauaucgaugcgcu

SEQ ID NO: 53919 - RNA, 72 nt, Escherichia coli CFT073
ggcaaaagaguugcaguuaagugcgguuucgauggguuacaucuucucugcuuuuggcugggccuacuugcu

SEQ ID NO: 53920 - RNA, 128 nt, Escherichia coli CFT073
ggauauccucauugcguggcugcaggacaauaucgacugcgaaucgggaauuaucuuugacaacgaugaggauaaaacggauucggcagcacuguugcccuguaucgaacaggcccgggaggaugucc

SEQ ID NO: 53921 - RNA, 75 nt, Escherichia coli CFT073
ggagcagaacagguuacggucgccguaaacaucauccagacguuucacggucggccaguauuugucugccacacc

SEQ ID NO: 53922 - RNA, 67 nt, Escherichia coli CFT073
ggaguggcugggauguauggauauguugucuggcggcaauuuugcugauggauccuguugccauucu

SEQ ID NO: 53923 - RNA, 85 nt, Escherichia coli CFT073
ggaguucuuuaaucugcuucauggcagcagcaaguucagaggcaggaacgaccuguucuccugcggccacagcaguaagacuucc

SEQ ID NO: 53924 - RNA, 119 nt, Escherichia coli CFT073
ggaguuuaaugaugucgcuuacuggccgcagaucaaacaggugcuggaguggucgaaagaucacgucaccucgacgcuguuugucugcugggcuguacaggccgcgcucaauauccucu

SEQ ID NO: 53925 - RNA, 67 nt, Escherichia coli CFT073
uugaugccgucuaacucguucauaggaaauacuccuugaaaaguaaaguguuagaugagugcguuaa

SEQ ID NO: 53926 - RNA, 67 nt, Escherichia coli CFT073
uugccgagaucagguuauucggcacagacugguaguucgccaguaacugcuugguaucuuucggcag

SEQ ID NO: 53927 - RNA, 64 nt, Escherichia coli CFT073
uuggcgggacuuacccauuucccuugccugcuuugggaugaggcugccgggaaaguuuugccga

SEQ ID NO: 53928 - RNA, 73 nt, Escherichia coli CFT073
uugcaucaauagcauucgcuuuuggacgaucaaggguaauuuccagaauugauccauugcgggucagauguaa

SEQ ID NO: 53929 - RNA, 61 nt, Escherichia coli CFT073
uugucuuugcuaucagucucaagggccgcgaaagcggcccuuuuuuacuuaguagagauaa

SEQ ID NO: 53930 - RNA, 75 nt, Escherichia coli CFT073
uuucauaagguuauuggcaauauaacguucaauucuuacuugcauuuuauauuagccaggaacuuugcccugagg

SEQ ID NO: 53931 - RNA, 89 nt, Escherichia coli CFT073
uuguuuagauuucguuuaaguuaaucgaccauacuggagaucgucagaaaauauuuccaggagauggcaugauucgcuuaucugaacaa

SEQ ID NO: 53932 - RNA, 68 nt, Escherichia coli CFT073
uuucaaaauggugcggaauuuuacugcaauugcugcugcuuuguaaagcaccgcggccuuuuuugaaa

SEQ ID NO: 53933 - RNA, 65 nt, Escherichia coli CFT073
uuuugaucacaguauuaucaaugacccgaaucugauccucgggcagauuauucugcugaucagag

SEQ ID NO: 53934 - RNA, 94 nt, Escherichia coli CFT073
uuuuuuaacagguuagauaauugcaauggcagucacugaacaggcaucucuugccauaaaacugucaucaaucaucuugacaaauguuaaaaaa

SEQ ID NO: 53935 - RNA, 73 nt, Haemophilus influenzae Rd
uuugccaaaugaucggcuucuuuuucuucaaaaauccagaagaauuuuggcauuggucauuuaguauggcggg

SEQ ID NO: 53936 - RNA, 130 nt, Haemophilus influenzae Rd
uuuaaauacgcaggcauuuacucgggugcaggcgaugaaugaaggcgacagugcgaugcaaacaacccauauuuugcuugcggaaaacagucguuuauucuauuugccgcauccguugguguuacauaga

SEQ ID NO: 53937 - RNA, 57 nt, Haemophilus influenzae Rd
uugucuggaauuagacgaagaagacuuggcguuauguucuuucguuuguccaggcaa

SEQ ID NO: 53938 - RNA, 63 nt, Haemophilus influenzae Rd
ggcgaaauugugacugaucgccucaaugagucuuuuggugaauuaaugaauuacgauuucacc

SEQ ID NO: 53939 - RNA, 55 nt, Haemophilus influenzae Rd
ggcugauaaagaucuaauggcuuuugaugcgccugauuuagaacuuuaucaugcu

SEQ ID NO: 53940 - RNA, 73 nt, Haemophilus influenzae Rd
gguauacaauauuggcuaugaugcaccaagcaaaaaauggggcauggauguguauaucaccgauguugcagcc

SEQ ID NO: 53941 - RNA, 66 nt, Haemophilus influenzae Rd
gggugugggaugcucguuuaacugcagaauuaauuuuauucuuucuuuaucuugguaucuuagccc

SEQ ID NO: 53942 - RNA, 70 nt, Haemophilus influenzae Rd
ggggggagcugucgcgaagugacugagggggauacguaaucccccuuccgcccuucgggcaccuuccccc

SEQ ID NO: 53943 - RNA, 60 nt, Haemophilus influenzae Rd
guuaaaaaaagaggcgugauuauagcaauuuuuguuauaguuccaaccuuuuuaguuagc

SEQ ID NO: 53944 - RNA, 66 nt, Haemophilus influenzae Rd
guuaugcguuuugaaggagauauuuucgguaauaaaaaaccgauguauuccguucaagaacaaaac

SEQ ID NO: 53945 - RNA, 62 nt, Haemophilus influenzae Rd
guuauuuacguucuuuggguuacgauuuaacuuaugugcguaauauaacggacguagaugac

SEQ ID NO: 53946 - RNA, 79 nt, Haemophilus influenzae Rd
guucuuuaucaauuaaaacaucagguuuauuaggugagcaauauauugccuugacaauggguuuugaugauggagauac

SEQ ID NO: 53947 - RNA, 68 nt, Haemophilus influenzae Rd
guaggggcaaguuacauuugccccuauauaucaacgaauguucaagggcaaaugugauuugccccuac

SEQ ID NO: 53948 - RNA, 130 nt, Haemophilus influenzae Rd
guacuugugcugcuuuaguuucacgcacaaucgcauugauaauaaguuguuuuguuucacgaucugcaccagcaacuuuuacuuuaaugaguucgugaugauuaagugcauuuucaauuucagcaaguac

SEQ ID NO: 53949 - RNA, 88 nt, Haemophilus influenzae Rd
uucugauaagcaugccuuauuuauuccaacaguacauucugaugccugcacgggauguggaaaaugugagcaagcuuguguguuagaa

SEQ ID NO: 53950 - RNA, 101 nt, Haemophilus influenzae Rd
uucagcgaauugagucuuccuuaaaacaacagcuuucgccuuuaucugaaaaagauuacgucaaagaaguucgugcauuaggggcgauuggggugguugaa

SEQ ID NO: 53951 - RNA, 58 nt, Haemophilus influenzae Rd
uggcgcaaguauaacaaaaagugcggucauuuuuaaccgcacuuuuaacacuuaguca

SEQ ID NO: 53952 - RNA, 58 nt, Haemophilus influenzae Rd
ugcaauugcaacaguaauugguaugcguuuauauggcgaugccggcguggcgauugca

SEQ ID NO: 53953 - RNA, 80 nt, Haemophilus influenzae Rd
ugaugcgcgcgugcgugcgguuucacacuuccguacuuuagauucagcggaagcguuagcagcagcaaacaaacguguca

SEQ ID NO: 53954 - RNA, 55 nt, Haemophilus influenzae Rd
ugaauguugguagagaguuuccaaaauguccuuugcauuuucuaccaacauugca

SEQ ID NO: 53955 - RNA, 65 nt, Haemophilus influenzae Rd
ucagaauaugaacucgcgaacgaagagaaugaaaaaccgcaauuuucuuuuggguuugauucuga

SEQ ID NO: 53956 - RNA, 58 nt, Haemophilus influenzae Rd
ucaucuuuuacgaagugcaucguaaacauuaucauacgugcaacccagaagaagauga

SEQ ID NO: 53957 - RNA, 67 nt, Haemophilus influenzae Rd
ucccaauuuagcugccgugauuuugccucgcucgggucuuggccauaaacacggcauuguguuagga

SEQ ID NO: 53958 - RNA, 99 nt, Haemophilus influenzae Rd
uccuucugaguuuugguuagauugcucuauuuuuaauugugauaagccugucaggguuuauaaauaucaguauagcaaccaagaaccagagucgaagga

SEQ ID NO: 53959 - RNA, 86 nt, Haemophilus influenzae Rd
uccguuuuuaaacagacuuuuaaugcaauuagugauccuaaagagcagcugauuguauuggaagauuuuuucaauuuaauuuugga

SEQ ID NO: 53960 - RNA, 88 nt, Haemophilus influenzae Rd
ucaagaagaauuaaugcacgaccacgguuuguuggaucguuaggaacaacaacuuuagcaccgucuuguaauucauucacauuuuuga

SEQ ID NO: 53961 - RNA, 64 nt, Haemophilus influenzae Rd
ucaagcaucuugucaucccauuguuuaguauggauguuaaauaacaugguacgagaugcguugg

SEQ ID NO: 53962 - RNA, 83 nt, Haemophilus influenzae Rd
guuguaaaaagcaccauuuuaguucguucauuaauugaaagcgguaaauauuacguaacugaaaugcuuagcucacuugcaau

SEQ ID NO: 53963 - RNA, 77 nt, Haemophilus influenzae Rd
guuggacgcugggcuguaauaggauauauugaagauuucugguugauauucuuauugcaacuuaugcacaguuuaac

SEQ ID NO: 53964 - RNA, 76 nt, Haemophilus influenzae Rd
guuggaugauuguggaucuguguuugugauuuauuauuugcuuuuucaauggcauaacagaacccaguuaaacgau

SEQ ID NO: 53965 - RNA, 77 nt, Haemophilus influenzae Rd
uacgaaagcggugcuuaaugauuuacaaagcauacauuuuucaaaaaaugauguauuaguugguaucgcugcaagug

SEQ ID NO: 53966 - RNA, 65 nt, Haemophilus influenzae Rd
uacgaagaaugucguacuagaaaaaagcuacgacagcuauuuuaacggugaugacaaucaacgug

SEQ ID NO: 53967 - RNA, 87 nt, Haemophilus influenzae Rd
uaagugcgguaauuauuggcaucguuuuagguuggcugugcaaagauugguugcauuuuccaaaugguuccaaucuuuacgugcuua

SEQ ID NO: 53968 - RNA, 63 nt, Haemophilus influenzae Rd
gcgcauuacguuuuagcaagguaauuccuuacgcaggaaauauugugacaaaugauauugcgc

SEQ ID NO: 53969 - RNA, 83 nt, Haemophilus influenzae Rd
gcggauuucuuuaagaauuuuuuccgcaauuugugcuuuuugaccagugagagaaagugcgguaaaaaauucgaggguuucgc

SEQ ID NO: 53970 - RNA, 59 nt, Haemophilus influenzae Rd
gcguuauaucaauuggacaggcugcggcaauaugcucaauuuauccucugauguagggc

SEQ ID NO: 53971 - RNA, 76 nt, Haemophilus influenzae Rd
gcuuuaauaaagguggugcgaccguagaagauguugcauugaugaaaaacacggucggcaauauugguguuaaagc

SEQ ID NO: 53972 - RNA, 73 nt, Haemophilus influenzae Rd
gcauaauuggcaacuaggauuagcaagcauauugucgccuuguuuuaguguguuuuugauuugccaaaacagc

SEQ ID NO: 53973 - RNA, 97 nt, Haemophilus influenzae Rd
gaguuugauguugccacaaacaucacaucagaaagaucauaauccacuucuaaauagugaucguuaaaugugguguuuugcucgggaucuaauacuu

SEQ ID NO: 53974 - RNA, 107 nt, Haemophilus influenzae Rd
gcacuuuuacggucuuuauaggauggguuucugcccaccaaagauuucauuaaucggugggcuuaaagcccaccuacagauuacauuacuaagcgacguaaaucugc

SEQ ID NO: 53975 - RNA, 59 nt, Haemophilus influenzae Rd
cgguguuauuuugacuugggguguggcagugccauauuucacaaugucagaagauauug

SEQ ID NO: 53976 - RNA, 69 nt, Haemophilus influenzae Rd
cuaacaaaaaacccucuguuuaaguagcgaaaaacagagauuuucgcuagaaugaggcguuuaauuuag

SEQ ID NO: 53977 - RNA, 89 nt, Haemophilus influenzae Rd
cuccccaaguauuacuuauaugaucauagccuaaaccaaugauauaacggcugggcugaauggcaucaaauaaauaacugcuuacggag

SEQ ID NO: 53978 - RNA, 94 nt, Haemophilus influenzae Rd
cucuuguggucaauguauuguuaaagugaaaaaugguggcggagaaauucuuccaaccgaacuuucucacauuaacaaacgugaagcaaaagag

SEQ ID NO: 53979 - RNA, 55 nt, Haemophilus influenzae Rd
cuuggcgaauuagcucaaauguugaaagaaacauauuguggcucaauuggcuugg

SEQ ID NO: 53980 - RNA, 64 nt, Haemophilus influenzae Rd
cuugagagaaaguaucgggaauaauacgcuuaucgcgcuuuuuuuuccagugcuuuauauuaag

SEQ ID NO: 53981 - RNA, 58 nt, Haemophilus influenzae Rd
gaaaaugugcggugcaaaacauuugauuauauuuuucauuuugcgcuuguagauuuuu

SEQ ID NO: 53982 - RNA, 55 nt, Haemophilus influenzae Rd
gaaaauuguccaugucaaucuagccaucauuacgcagauuguuguggcaaauuuc

SEQ ID NO: 53983 - RNA, 101 nt, Haemophilus influenzae Rd
aacggauaucacauugccaucgcgucaucuuguuuuuaugccugaaaauagccacguaggcguuucacaacgcauugaaagcgaagaagaacgcgcccguu

SEQ ID NO: 53984 - RNA, 57 nt, Haemophilus influenzae Rd
aaacaaugccacugccauaacgaauuaauuuugccauuuguucuggcgugauuguuu

SEQ ID NO: 53985 - RNA, 79 nt, Haemophilus influenzae Rd
aaucguaaacguugguuacgcacagggaaauguucuuucuuaccggaagaacgagcgugguaucaacguuuguaugauu

SEQ ID NO: 53986 - RNA, 100 nt, Haemophilus influenzae Rd
aggguaguauugaagaugcuuaucaacuugcuaaagauuuaguuacagaugaugcgguaaauaaauugaagcaauugguuggcaauaaaaaugcaauucu

SEQ ID NO: 53987 - RNA, 81 nt, Haemophilus influenzae Rd
auaaaauuagccuacaaaauuaccgcacuuuaggugaaaccuucucacuuaccuugcgccguuuugcaggcguaauucugu

SEQ ID NO: 53988 - RNA, 126 nt, Haemophilus influenzae Rd
acgccgauaccacauuccauaccguuacgaacuucagauacgucgucuuugaaacggcgaagagauucuaauuccccuucaaauauaacgacguugucacguaauacacggauuggguuguuacgu

SEQ ID NO: 53989 - RNA, 69 nt, Haemophilus influenzae Rd
agcacuagaacaguuuuagaaugcuaauuugguuuaacaaaggcuguguuuuaauacuguguuaaugcu

SEQ ID NO: 53990 - RNA, 77 nt, Haemophilus influenzae Rd
auuuuuucagcaaguguugcaucuuuauccaauuuuuuaucaaauguuggaucgggcgcaauaaguuuuggaucaau

SEQ ID NO: 53991 - RNA, 65 nt, Haemophilus influenzae Rd
auuuaaaauggcaucggcuuguucaucgcuuaaauuaaagcgugccauaagcucugcuuuuggau

SEQ ID NO: 53992 - RNA, 78 nt, Haemophilus influenzae Rd
auggugcuucaauaccauuuacuaauaagcgauugccuacaaagugcgguugauuuuguuugaauaauuggagaccau

SEQ ID NO: 53993 - RNA, 100 nt, Haemophilus influenzae Rd
caggauugguuuuaugguauuucaucacgucuuacuuuuaguuaugccaaccgaguguauagagagaaagauuugauugguauacagcaaaaaaaucgug

SEQ ID NO: 53994 - RNA, 102 nt, Haemophilus influenzae Rd
cagugauaaugcuuguaccuucugccaccauauuuaauaaaguaaauugagccugcauaucaguugggaacccuggauguggugcaguacgaauauucacug

SEQ ID NO: 53995 - RNA, 97 nt, Homo sapiens
cagugaucucauaaagugcacugagaauaguugccaaaguuuuguuaagagcuuuuugggcagcuauugacuuuauauaauguuuauuagauuacug

SEQ ID NO: 53996 - RNA, 66 nt, Homo sapiens
cagugggcgcugagcugugaccucucucugcaggacugacagcuauucaucaguuggugcucgcug

SEQ ID NO: 53997 - RNA, 59 nt, Homo sapiens
caguguuuuuacaagcacucugggugauucugauaaauccagaaauuugagaaccacug

SEQ ID NO: 53998 - RNA, 58 nt, Homo sapiens
caguucuuaugcugguggcuuccaaaccucacuuugagaaauacugccuuaggagcug

SEQ ID NO: 53999 - RNA, 59 nt, Homo sapiens
caguugaaagacauggggaugaugugguagacuaaauuauugcucccaauuuuucacug

SEQ ID NO: 54000 - RNA, 57 nt, Homo sapiens
cauaaagauggaggaggccaggcaggguggauuaugccuguaauccagcacuuugug

SEQ ID NO: 54001 - RNA, 67 nt, Homo sapiens
cauaaaugaguagguguuuuauguuuauccuuucccaugggauucccauaaugcuacuuauuuuaug

SEQ ID NO: 54002 - RNA, 60 nt, Homo sapiens
cauaauguaugaggauagguuucuauuaggcuguauguuugagaaaguuuuccucuuaug

SEQ ID NO: 54003 - RNA, 123 nt, Homo sapiens
cauaccgugcaauauuaugcauaauaaauuuccaaauggauuucagcugaguauucaguauguuacugaauacuggcacugaagaccaugaaaugcacauaauagaacuguacuuuuggugug

SEQ ID NO: 54004 - RNA, 66 nt, Homo sapiens
cauagguagcauagcgggaauaucagugguacguuguuccucucuguauuauugcuauggccuaug

SEQ ID NO: 54005 - RNA, 92 nt, Homo sapiens
cagugagguugaauacacuuuguacuggcuuguuucagagaggaaacucuaaccucuuuggcauuagccuguauagaacucaccccuuacug

SEQ ID NO: 54006 - RNA, 83 nt, Homo sapiens
caguccuguuucaauguuaauuuccugauuuugauaacugauauuauugagauguaagauguuaauauuaauugagaaagcug

SEQ ID NO: 54007 - RNA, 58 nt, Homo sapiens
cagguucaagcaauucuacugccugagccuccucaguagcuggaauuacuugcaccug

SEQ ID NO: 54008 - RNA, 66 nt, Homo sapiens
caguaugucuuuugcuugcaaauagauugcucauugccaacugcuuccaagaaagagauagggcug

SEQ ID NO: 54009 - RNA, 64 nt, Homo sapiens
cagucaagguguaggaguaaagaagucaaauauuuaugugugauuuauagcuacaucuugacug

SEQ ID NO: 54010 - RNA, 69 nt, Homo sapiens
cagucacuucaugguuucuuggacaggcagauccuggccauguucauguaauuccauaagguaaggcug

SEQ ID NO: 54011 - RNA, 64 nt, Homo sapiens
caggugcauuggcugacaccuguaauccuagcacuuuaggaggccaaggugggcgaaucaccug

SEQ ID NO: 54012 - RNA, 67 nt, Homo sapiens
cagguggugccucagggacuuacaaaccagaagguuccaugccuuccccuuuaguggguauuauuug

SEQ ID NO: 54013 - RNA, 72 nt, Homo sapiens
caugauuaaagauguucucauuucauagguucuuauaucugaauuguaugagagugaaagcauuucugcaug

SEQ ID NO: 54014 - RNA, 63 nt, Homo sapiens
caugcaaauagcacaugugcaaauggcugugugugucuccauacacacacauguguauguaug

SEQ ID NO: 54015 - RNA, 120 nt, Homo sapiens
caugcaucucauuuguaccuuucuccuaucaaguguauggauuuucagauucuuaucuuuuagaaggaugagcugcucaaucuguggucugugauggaaggcagguagggugaguucaug

SEQ ID NO: 54016 - RNA, 128 nt, Homo sapiens
caucucuauaauaaaaaggaaaaagaggaauccccuuuguagguuucauaguuuauacugauauuucugaugucgucucagagaauuagucacaauuauaggaacucagaaggcauuccguggagaug

SEQ ID NO: 54017 - RNA, 67 nt, Homo sapiens
caugauccuucaaaugaagugggauaaggagauccgcccaacaucccaguuuuucugaauagucaug

SEQ ID NO: 54018 - RNA, 63 nt, Homo sapiens
cauggauuuuuuugaauggcaguuauccaaguauggucuaggggcccuucgggggagucuaug

SEQ ID NO: 54019 - RNA, 55 nt, Homo sapiens
caugacacuggcauguuucuuuagugaugauaaaggcgacaugaucaguggcaug

SEQ ID NO: 54020 - RNA, 60 nt, Homo sapiens
caucagaaugugcauuuuaacaaggaacccagguaauucaaaugcacauuacugcuggug

SEQ ID NO: 54021 - RNA, 85 nt, Homo sapiens
cauccagcuacacguucuuucaccaucaucacccuccaguauugagugugagguacgugucaagaaccacacagcuuuucggaug

SEQ ID NO: 54022 - RNA, 76 nt, Homo sapiens
caucccagagacagaaugauaaacuguugucagcagccgaggaagacagaccccaguuuacacugcuuugagggug

SEQ ID NO: 54023 - RNA, 61 nt, Homo sapiens
caucccuuucugauacuuucccugaaucccagucuggaaaggguaguaaaagaggcgggug

SEQ ID NO: 54024 - RNA, 77 nt, Homo sapiens
cauauauauagcaguauacguacuggguccaauacuucgggugaaaaugaggccuacuguguauaugcuaguauaug

SEQ ID NO: 54025 - RNA, 83 nt, Homo sapiens
cauaugugugccugugcaugacagcauacaaacgugcauaguguguauguguguaugcaugugugcaugagugugcacaugug

SEQ ID NO: 54026 - RNA, 62 nt, Homo sapiens
cauauuggaugugggauaguguacaucaaugaaaaugaacuaauguugcacauaucaauaug

SEQ ID NO: 54027 - RNA, 77 nt, Homo sapiens
caucacauauucucacuuauuucuggguuccaaaaaucacaauaauuuaacucauggagauagagaauagaagggug

SEQ ID NO: 54028 - RNA, 81 nt, Homo sapiens
caggauuuugcuaugucagccaggcuggucuugaacuccugaccucaggcgaucugccugccuuggcgucucaaagugcug

SEQ ID NO: 54029 - RNA, 79 nt, Homo sapiens
caggcaaucuuccuaaauuucuuccucugugagauaguauaucauuucacugaggucugagcuuuaugaauggguccug

SEQ ID NO: 54030 - RNA, 81 nt, Homo sapiens
caggagaucagaguuagaauuguacugcaaucaggggaauauuuugccuugacuacgguucaguuaaaaguucauuuccug

SEQ ID NO: 54031 - RNA, 55 nt, Homo sapiens
caggaggcggagguugcagugagcugagaucgcgccauugcacuccagccugcug

SEQ ID NO: 54032 - RNA, 55 nt, Homo sapiens
caggaguucucucauuuauagauuauuacagcucugugagguagaggguuaccug

SEQ ID NO: 54033 - RNA, 63 nt, Homo sapiens
cagcuggaaagagguuuuuuuggguaaaaucccuagaaacauucucuugccuccuuccagcug

SEQ ID NO: 54034 - RNA, 79 nt, Homo sapiens
cagcugucaacaccucugggccucugguccauucucccuguuaagaaagagaaaauggcaagagccacagaggcggcug

SEQ ID NO: 54035 - RNA, 122 nt, Homo sapiens
caggaagaauaaauggauggggaacagauuaacugguaaauaguucucuuuggaauuugaauacauuugagagacagacauuaucuuauauaagagucuguucuugugugguuaaauucuug

SEQ ID NO: 54036 - RNA, 60 nt, Homo sapiens
caggaaugugaggguucccugccugaaaaguuaguaaggcagaggagaucucauguccug

SEQ ID NO: 54037 - RNA, 76 nt, Homo sapiens
caggacaguggggguggguuucuguugcuuuaagcccccgaguuugcuacagcagcccaguccccgaaccuuccug

SEQ ID NO: 54038 - RNA, 61 nt, Homo sapiens
caggacgcauacacguuaggcgaagucauccuuggugguguuucuauggugaugaguccug

SEQ ID NO: 54039 - RNA, 91 nt, Homo sapiens
caggguuuugcucuguugccuaggcuggagugcaguggcgugaucucugcucacugcagccucugccucucagguucaagcaauucuccug

SEQ ID NO: 54040 - RNA, 79 nt, Homo sapiens
cagguccaguaagacguacuauugguuuauaccuuuuuacauaaauuguacuacaccauaguacugaguacaccaccug

SEQ ID NO: 54041 - RNA, 84 nt, Homo sapiens
cagggcuguguagugcaaugagaaggggcucuggagccaaacacagccagguuccaacccugguuccuucauuuuccaguuuug

SEQ ID NO: 54042 - RNA, 90 nt, Homo sapiens
caggggaaucacuugagcccaggagauggagguugcagugagccgauauugcuguugcacucuagccugggcaacaagaaugaaacccug

SEQ ID NO: 54043 - RNA, 60 nt, Homo sapiens
caggguaaaccuaugagauagcuguugcuauugacauuucuaucucaguguuuacauuug

SEQ ID NO: 54044 - RNA, 76 nt, Homo sapiens
caggcccagcagggagaccaucucuuccuuaggacuugccuuaggucccauguccucccugaccacugauggccug

SEQ ID NO: 54045 - RNA, 82 nt, Homo sapiens
caggcuaauugucauacauuugcaugcuaaaagacacucccaccagugccauggcaguuuacaaaugccaugacagugccug

SEQ ID NO: 54046 - RNA, 98 nt, Homo sapiens
cagggccuccaagcucacucagaaaucuuguguugaauggugcagagcuaaguuguucacucugcaguaucauauuagaagagauuugguuuacccug

SEQ ID NO: 54047 - RNA, 78 nt, Homo sapiens
cagcauuaugcacuuuacucauuuaagguauguugugaugugaacaaaucagccuguagaagaguagaugaccugcug

SEQ ID NO: 54048 - RNA, 116 nt, Homo sapiens
cagccaagugcucagcacauaaagugcuuacuaaguugccaacuuaauagacuccuauggauucauuuauuuggcaacucaguaagcgcuaauauaugucauauguaucauuucug

SEQ ID NO: 54049 - RNA, 62 nt, Homo sapiens
cagccaaucugauucuauaccauuucuuagaacaaagaagagugcuauagauuagauuucug

SEQ ID NO: 54050 - RNA, 75 nt, Homo sapiens
cagccacugugaaagauuuuaacugggagacuccuauacccggaagucuuucaguucugaaucucggcaggucug

SEQ ID NO: 54051 - RNA, 55 nt, Homo sapiens
cagcagguuuuuaucaguuaagcugcuucuaggcaacugguagaaaugucugcug

SEQ ID NO: 54052 - RNA, 57 nt, Homo sapiens
cagauuguagcaauugaguacaggauauuccugugaacaaaauuuguugcauauuug

SEQ ID NO: 54053 - RNA, 102 nt, Homo sapiens
cagauuugcuacacggguaaauugcaugcugcggggguuuaguguacagaugauauugucacccgggcaguaagcauaguacccaauagguaguguuuucug

SEQ ID NO: 54054 - RNA, 84 nt, Homo sapiens
cagcacgugcuacuggaagaauaaugggccuuagagcuagcaaaacugaguucaaauccugcuuaugcuaccaguugugugcug

SEQ ID NO: 54055 - RNA, 97 nt, Homo sapiens
ccaauauuaaugagaaaugagucacuuauuauuggggugcaaauagagagauaaaugacaucaguaauuaagucucaagcccucuuugguauaaugg

SEQ ID NO: 54056 - RNA, 130 nt, Homo sapiens
ccaauuugauucuucugcaugugaauauacaguuuuccucacaaccuuuauugaagagacugcccuuuccccauugucuguucuaguuguaugugauuaguugacuguaaauguguggaauuauuucugg

SEQ ID NO: 54057 - RNA, 64 nt, Homo sapiens
cauucuuguauagguuuuuguaacacaaauuuuuauuucucugugauaaaugccuacaagggug

SEQ ID NO: 54058 - RNA, 55 nt, Homo sapiens
cauugcacuuagacaacuuuuguuucaaguguguguugaggguauaagugcaaug

SEQ ID NO: 54059 - RNA, 55 nt, Homo sapiens
cauuguggucaaggauggaccacauauaugaugguggucccauaagauuacaaug

SEQ ID NO: 54060 - RNA, 87 nt, Homo sapiens
cauuugaugaugauuccauucgaguccauuugaugaugauuccauucgaguccauuugaugaugauuccauuugaguccauuugaug

SEQ ID NO: 54061 - RNA, 55 nt, Homo sapiens
cauuugguguaguucucuguuguuguacccauaacauuguugauuauacuaagug

SEQ ID NO: 54062 - RNA, 67 nt, Homo sapiens
cauuuguucagucugaauacaaaucaaggguaaaaaccacauggcagugucacagacaugacagaug

SEQ ID NO: 54063 - RNA, 79 nt, Homo sapiens
cauuuuacuccugacugauuacauuacauauugauauuagugagcaucaguauguagugcaaucagucaggagaaaaug

SEQ ID NO: 54064 - RNA, 115 nt, Homo sapiens
cauuuuauuaauggagcuaauugcaugcacuguauaggaucuugcggaaaauaaauuacaguauauaaaaugucuccuaguauggugcauuguacaugguugacauucaaaaaug

SEQ ID NO: 54065 - RNA, 78 nt, Homo sapiens
ccaaaggguguggauguuuccuuauugauaucaucaaagaucuaguguaucaagaugacaaacuuugcucccuguugg

SEQ ID NO: 54066 - RNA, 96 nt, Homo sapiens
cauuauguuuuauaaaaauuuucuauuaucuagaaauuucagcagauuggcaguuggaaguauagauaauugaaaguggguacuauaauaguagug

SEQ ID NO: 54067 - RNA, 75 nt, Homo sapiens
cauuauuacauucagcuguuguuucaaugugucugaaaggguaaaugacuauuuagauggccuggguguguggug

SEQ ID NO: 54068 - RNA, 120 nt, Homo sapiens
cauuauuaucucuaucugacauauaaggaaacuggaucccuuaaaguuaaguuaccuguccuggaugacauagcuauuaagugaugccaagucuccuuuauuuuagauguguauauaaug

SEQ ID NO: 54069 - RNA, 60 nt, Homo sapiens
cauucauguugcuuguucuacuuaauauauuaagugcuauguggaaagcagcaugauaug

SEQ ID NO: 54070 - RNA, 129 nt, Homo sapiens
cauucccugagauaggucacucucccuuucugaagcucugacucuucaucgauaagauagggacacuaaucuucucuugaaggguggggaagauaagaugaagugguaagugacuucacauaguggaug

SEQ ID NO: 54071 - RNA, 101 nt, Homo sapiens
cauuccgucaugcauguuuagacuucauggcuuuuuaaaucauguuguagugugguuacaaugaagauaaaagcuagaggaaaacacuccaugcaggaaug

SEQ ID NO: 54072 - RNA, 102 nt, Homo sapiens
cauuccuaccuuaaucuucagagauccuugaaauguuuagaaguuuggauuugauaguacauccaaagcugaagcauuucuaguucuuucaagcagggaaug

SEQ ID NO: 54073 - RNA, 76 nt, Homo sapiens
cauggggaguacuugagauaggagcuguuguucucuucuggccuaaacuaagacccgucuccugucucaccccaug

SEQ ID NO: 54074 - RNA, 57 nt, Homo sapiens
caugguguauaugugccaaugggugcagcacaccaacauggcacauguauacauaug

SEQ ID NO: 54075 - RNA, 63 nt, Homo sapiens
caugucuuuuauucugugugaugaaacauucugccuaucuccucacacagaauaaaagaugug

SEQ ID NO: 54076 - RNA, 66 nt, Homo sapiens
caugugcaaagcacuguucagcaggggagcucaccugagccuugcugucaagggcuuuagcaugug

SEQ ID NO: 54077 - RNA, 78 nt, Homo sapiens
cauguguguguaugcacaugugccugggugugugugucugugcaugucccugggugugugugcaugcaugugugcaug

SEQ ID NO: 54078 - RNA, 94 nt, Homo sapiens
cauguucaguauugaaauccauucuuggcuuugcuuuaauagcagagauuugacuucugacauuguugaucacagccauggaaauaaccacgug

SEQ ID NO: 54079 - RNA, 102 nt, Homo sapiens
cauuagaagaauugcugcuugcuuaucuccuuuuaaggggccaucaguaugaaagguuaauauuuucaauacuguugauccuuaugugauaguaaucugaug

SEQ ID NO: 54080 - RNA, 75 nt, Homo sapiens
cauuauauuacagcacuguuaaagauacugaaauauauugaaguuuuaccuugacauugcuguaguguccagaug

SEQ ID NO: 54081 - RNA, 87 nt, Homo sapiens
ccagaaauuaaaggcggauagauccuucucaaaaucaaacgcucucuuugguuuugcacuguuuuaucugacaauuuugaguuuugg

SEQ ID NO: 54082 - RNA, 111 nt, Homo sapiens
ccagaccucugaggagggggagcugccuggcagaggcuggugccucagaagcuaagaagagggucuuauguaacugggacacaagccucugaggguagcaucagaggcugg

SEQ ID NO: 54083 - RNA, 72 nt, Homo sapiens
ccagaccuucagagugaggcucucggaacucacucugaaguuaaaguucuucgccucucuuugaaaguuugg

SEQ ID NO: 54084 - RNA, 69 nt, Homo sapiens
ccagaggguuaaguuucaauugaaaaguaaagguucuuuuuuagaucaacauggaacucuaucuucugg

SEQ ID NO: 54085 - RNA, 75 nt, Homo sapiens
ccagagucugugccucaagcuaaagaagugaaagcuccuuucauucauucauccagcuugaggaagagacccugg

SEQ ID NO: 54086 - RNA, 76 nt, Homo sapiens
ccaaguaaaugguguuuccguuaagcugaacuauaaaauguggguuacuuaaacagaaaugcagaaaggcacuugg

SEQ ID NO: 54087 - RNA, 77 nt, Homo sapiens
ccaaguugucauaagccuauuauuucuuuacauuacugaagugaaagacagcauuaauggcuaaaugccauacuugg

SEQ ID NO: 54088 - RNA, 60 nt, Homo sapiens
ccacaggugaugacauuugaaccaagccuuaaagaauuggcaagaauucuuaccgugugg

SEQ ID NO: 54089 - RNA, 78 nt, Homo sapiens
ccacccggcuugggcagcauccaugugcuuccucucccguggcacauaagcaggugucugugucuguaaaccgggugg

SEQ ID NO: 54090 - RNA, 85 nt, Homo sapiens
ccagcaugggagaaagaugagguagaagacucagcaaguuggcuuuucccaccuucuuccaucugcuuuauccuagccgagcugg

SEQ ID NO: 54091 - RNA, 64 nt, Homo sapiens
ccagauggucaccuucuugcucugucuucacaggguagagagagagagagagagggaucuuugg

SEQ ID NO: 54092 - RNA, 58 nt, Homo sapiens
ccaucacaugcuuauuuuccucauuggaaauucagaugaggacagaaagguguggugg

SEQ ID NO: 54093 - RNA, 74 nt, Homo sapiens
ccaggcuacugccuguguucacuuaaggcugaagggcuucucagucagcuuguggugaauacugcuaggccugg

SEQ ID NO: 54094 - RNA, 129 nt, Homo sapiens
ccagugccuaacaauagaggcaaacccgugagcagaaagcugcaaggucgugugcucagcaggaggugaggcugggguggcugagcagcgucuguucagugcuacuuuccucugagacggguccacugg

SEQ ID NO: 54095 - RNA, 99 nt, Homo sapiens
ccagugugcguguugcuaauuguauggcaggaggcacacggcaugcucugugugcucaucacaugcaauaggacaacauauugagccacagugcauugg

SEQ ID NO: 54096 - RNA, 61 nt, Homo sapiens
ccaucuaaagagcagguggauuuccuuugguguaauccucaccuccauuuguaugggaugg

SEQ ID NO: 54097 - RNA, 59 nt, Homo sapiens
ccaugaaagcaaauacaaaauggcugacuauaugcagcuaguauucacuuuuuucaugg

SEQ ID NO: 54098 - RNA, 103 nt, Homo sapiens
ccaugagcaaguacuuccaccucucugagcaucaguggccucaucucagaagacugcugggaagaguaaccaggaugcugggugugaagcuccuagcacaugg

SEQ ID NO: 54099 - RNA, 79 nt, Homo sapiens
ccaugaucagaugguggcaagagccaagucuucucacauaaagagaaaucacauugaaucugcuaccuacgaccacugg

SEQ ID NO: 54100 - RNA, 83 nt, Homo sapiens
ccaugcuuggaguggaagcaagggauggugugagaaauagaaaaauucuuacaucaucacauuaguuugcgucuccuguuugg

SEQ ID NO: 54101 - RNA, 58 nt, Homo sapiens
ccauggcaauggucagucuauucaaacauaagccuggcauggugcuggccucccaugg

SEQ ID NO: 54102 - RNA, 79 nt, Homo sapiens
ccaugguaauacugugauaucgagcgauugucugggccauugucccacaucuugucuggguacacaguacugaacaugg

SEQ ID NO: 54103 - RNA, 78 nt, Homo sapiens
ccagcugaaaucugggguuguuuggggaguagcugggagacacgggagacuccccgagagcugcgggugagcugcugg

SEQ ID NO: 54104 - RNA, 93 nt, Homo sapiens
ccagcuggagugcaguggcacaaugucagcucacugcaaccuccgccucccagguucaagcgauucuugugccucagccucccaagcagcugg

SEQ ID NO: 54105 - RNA, 125 nt, Homo sapiens
ccaggacaguuguaaaguacuuuguaagauauauuuugugaaaucagauagccuuuuuaaauagccuuuagaaaagcugcucuguuucuaaaauguugugacugauuuuuacuucguaacucugg

SEQ ID NO: 54106 - RNA, 62 nt, Homo sapiens
ccauuugcuagccauguguacuuggguaaguucccacacccucugcauugucugggaaaugg

SEQ ID NO: 54107 - RNA, 56 nt, Homo sapiens
cccaaaggauucauuuccaggagucugaaaagauucuggaauuuggauauuuuggg

SEQ ID NO: 54108 - RNA, 62 nt, Homo sapiens
ccaugugauuagaaauguacacagcaguacugcugaccuaaaaaauuacauuuguuacaugg

SEQ ID NO: 54109 - RNA, 76 nt, Homo sapiens
ccauuauugcaaagcguagacucuaaacauauuauuagcaucaaaaaauguuuguuuuguaucuuuguauuaaugg

SEQ ID NO: 54110 - RNA, 62 nt, Homo sapiens
ccauucagaugccugagaacagcuaagcuccguaaaguugguucucuuagccaucuuaaugg

SEQ ID NO: 54111 - RNA, 100 nt, Homo sapiens
cccaacuaaaaaauacagauuguacagguugccagugaacucugauuagggauauuuauuaauuuacuuucauaggucacuguaaccucgugcucuuggg

SEQ ID NO: 54112 - RNA, 103 nt, Homo sapiens
cccaacugcagcaguucagagaaugucuuuuuuaaccauuugauacccauuugguagaauauaguauauuggagaugugucuugaaauuggaugccauuuggg

SEQ ID NO: 54113 - RNA, 105 nt, Homo sapiens
cccaauuguuuguguguauuuaucuaagagguagaagcuugccuucuauucuuccugugagguagaagcuugccuucuauucuuccugugugcauaaauguuggg

SEQ ID NO: 54114 - RNA, 125 nt, Homo sapiens
cccaccuuggccucccaaaguguugcguuuacaggugugugccaaggugcccacucaaaaacggguucuuggcugggcacuguggcucaagccuguaaucccagcaccuugggggucaagguggg

SEQ ID NO: 54115 - RNA, 130 nt, Homo sapiens
cccaccuugguuucacaacaugcugggguuacaguugugagccaccaugcccuggccaagugaaauuaggaaugggcugggugugggggcucaugucuguaaucccuacccuuaggcaagcagaggcggg

SEQ ID NO: 54116 - RNA, 68 nt, Homo sapiens
cccagagagguggguggagcccccaauuccugaaaaauugggggcuccacccaccucuaauguauggg

SEQ ID NO: 54117 - RNA, 116 nt, Homo sapiens
cccagcaccccccgcccagcuccccuaaugcacuuuccuccaaggcuggugaacuagacagaccggccaugggaaggaagaguguguaaugaccguggcaggggagggcugcuggg

SEQ ID NO: 54118 - RNA, 82 nt, Homo sapiens
cccagcugauuuuccugccuccuggcugguccagugugacccaguagacagaacaauggacuaggagcuaggaagaucuggg

SEQ ID NO: 54119 - RNA, 56 nt, Homo sapiens
cccaggaguuggaggcugcagugagguaugaucaugcuacugcacuccaccuuggg

SEQ ID NO: 54120 - RNA, 56 nt, Homo sapiens
ccauuucacucuuccugaaggacccggcaggcggguggaggaggggugggaaaugg

SEQ ID NO: 54121 - RNA, 56 nt, Homo sapiens
cccagggggcagagguugcagugagcugagaucgcgccauugcacuccacccuggg

SEQ ID NO: 54122 - RNA, 56 nt, Homo sapiens
cccaugauucaauuaucucucacugggucccucccaugacaagugagaauuauggg

SEQ ID NO: 54123 - RNA, 64 nt, Homo sapiens
ccccagugcucuucacacugguuuaggauggagacauauauggauaguuuacugaagagugggg

SEQ ID NO: 54124 - RNA, 104 nt, Homo sapiens
ccccaucacgggauugucgacuucaucaaauccacaagaccccuuuucacugugaaguaauauagucacagguucuugggauuagaggaugaacaucucugggg

SEQ ID NO: 54125 - RNA, 78 nt, Homo sapiens
cccccuugaggaggcagucuaucucuuaguagagcucaagcgcugugcuaggagauccacugcucucuucagagccgg

SEQ ID NO: 54126 - RNA, 97 nt, Homo sapiens
augguuauuaugagguggggguuuuccugcacaagcucucuuuuugccugaugccaaccagguaagaugugacuugguguuccuugccuucugccau

SEQ ID NO: 54127 - RNA, 66 nt, Homo sapiens
augggaaguauugccaucuuaacgauauuaaauccuccaauucauaagcaugguguaucuuuccau

SEQ ID NO: 54128 - RNA, 60 nt, Homo sapiens
augccucccaaaaguguucauauuuuaauucucagaacaugugaacauguuggguggcau

SEQ ID NO: 54129 - RNA, 70 nt, Homo sapiens
auguaugucuugucuauggcugcuuuuguauuauggcagcuaaaccgaguagcuaucacagagacuacau

SEQ ID NO: 54130 - RNA, 113 nt, Homo sapiens
auguaaauccuugcauauggcuuaacacacgugggcaaugugcacauuuacacauaguccagccuauacaugugcacaugcuuacaugugauuugauauguauggguguauau

SEQ ID NO: 54131 - RNA, 82 nt, Homo sapiens
auguaaguaguuuauauucaaugauuaguaucaguuggccaagccagucugugcuugauuauaugagugugugugugugcgu

SEQ ID NO: 54132 - RNA, 60 nt, Homo sapiens
auguaauguuaaauugcuaauuugagaucuuucuuucugaaauaggcuuuagcauuauau

SEQ ID NO: 54133 - RNA, 71 nt, Homo sapiens
auguagcuauaguuauuuuuaauccuuuuguauuuuuacucuuacacuggaguuaaaggugauuucugcau

SEQ ID NO: 54134 - RNA, 78 nt, Homo sapiens
augcucuuagugcauuuguucugugucaggcacuguuuuccauaguguuuguccagugccaggugcugcuguaaguau

SEQ ID NO: 54135 - RNA, 75 nt, Homo sapiens
augcugcguaucaacaggguggccaguguauuuuuacauguaaguacacaaaggcacucuguuguuaccacgcau

SEQ ID NO: 54136 - RNA, 85 nt, Homo sapiens
auggaaaugauuuaccuuuuguuuuaaguaaucagagaagagaacugcaaaugcaguuuguguacucaggaaguaaauuaucugu

SEQ ID NO: 54137 - RNA, 63 nt, Homo sapiens
auggaauguauagucauguagguuaacuuugugaguauacuguuuaaugucuguacagucuau

SEQ ID NO: 54138 - RNA, 70 nt, Homo sapiens
auggacacuaaggaaggacugaaaggacaggagcuauaggcugcucucucuuccccuuuccuuguuccau

SEQ ID NO: 54139 - RNA, 76 nt, Homo sapiens
auggaccauagcauagucagcuucgcugauucagcucuuuucacuagucaccguggcugaacuauuuugucaccau

SEQ ID NO: 54140 - RNA, 60 nt, Homo sapiens
auggacuuggaagccauuauucuaagugaaguaacucaggaauggaaaaccaaguaucau

SEQ ID NO: 54141 - RNA, 116 nt, Homo sapiens
auggagguguaaagauauccagcuuuauuaucuuugcauaacaauguauguguguauaucuguaaguauaugcauacauguaugcaggaauguuaauuguuguauuacacuucuau

SEQ ID NO: 54142 - RNA, 55 nt, Homo sapiens
auggaguguggaacugggaaucugacaaguauggauuccaauuuuggcacaccau

SEQ ID NO: 54143 - RNA, 97 nt, Homo sapiens
auggauaaaguacaucugucuaagaaaagagucuauaaacagauuguugaacuuuuuauuugucauagaugauuuuuuucggggggaguuuguuugu

SEQ ID NO: 54144 - RNA, 90 nt, Homo sapiens
auggcacagagguauuggaaggagugucagaugcucagguagaaugaaucuaucaacucuggcacuucuguguacuucugagucugccau

SEQ ID NO: 54145 - RNA, 86 nt, Homo sapiens
auggguaaauugcaugucauguuuaguguacagauuauuuugucacccagguaauaagcauaauaucugacaggcaguuuuuccau

SEQ ID NO: 54146 - RNA, 69 nt, Homo sapiens
auggguagggauagagagcagauuuauguuuuaaccauauguuaaucuguucucuguauucuauaccau

SEQ ID NO: 54147 - RNA, 77 nt, Homo sapiens
augguagcaaagcugagaugagaaucaguucuaauuuuaaauugagagcucuuuucauuauacuacgcugcugcuau

SEQ ID NO: 54148 - RNA, 72 nt, Homo sapiens
augguauuucuaguucuagauccuugaggaaucaccacacugucuuccacaaugguugaacuaguuuaccgu

SEQ ID NO: 54149 - RNA, 72 nt, Homo sapiens
augguauuucuaguucuagauccuugaggaaucaccacacugucuuccacaaugguugaacuaguuuacggu

SEQ ID NO: 54150 - RNA, 65 nt, Homo sapiens
auggucccauucauucacguauuugucuacuaauugacagcuauugaguaccuaaugggaaccgu

SEQ ID NO: 54151 - RNA, 82 nt, Homo sapiens
auggucuuccaaaaauaauuauaaguuaagaaaauaacuuucaaaguaguaguuuuguguauaauaauggcuaggaagccau

SEQ ID NO: 54152 - RNA, 66 nt, Homo sapiens
auggugaaagaggacauccucaucuuguuccucaucuuagaggggaaacauccagucuuucaccau

SEQ ID NO: 54153 - RNA, 74 nt, Homo sapiens
auguuugagaugauggauaugcuaauggccauguguaauggccuauuugacauuauauacacguaucuaaacau

SEQ ID NO: 54154 - RNA, 93 nt, Homo sapiens
auguuuuaagguuaagguuaggaaguaauaaguuugguucuaauccaaauauuggugccugauucuguguuauuuauaacugccuuguaacau

SEQ ID NO: 54155 - RNA, 72 nt, Homo sapiens
auuaaugaggcaggaaaggcguaucugggaaauaaaaucaucaucuaagcauggcuuuucuucuuuguuaau

SEQ ID NO: 54156 - RNA, 114 nt, Homo sapiens
auuacaauaggauauuuagagguaaaggaggcaagcuuauguucuuuaucuaauuucacaugccaacagauugcuauuuauggauugucuccuugugccauuuccuauuguggu

SEQ ID NO: 54157 - RNA, 83 nt, Homo sapiens
auuagaugagauauuuuauaagaucauuuuagagguggacuuuguucauguauacguguuuuaugauaaauaucuugccuagu

SEQ ID NO: 54158 - RNA, 128 nt, Homo sapiens
auuagcugggugugguggcaggugccuguaaucucagcuacuugguuggcugaggcagagagcgauccucacaucucaaccucccaaguagcugggauuauaggcacgugccaccaugccuggcuaau

SEQ ID NO: 54159 - RNA, 128 nt, Homo sapiens
auuaggaacaguaucacuugagggguguaccucuacugcgauaucaggcauaauaacauccucuccccccgaauauuaagaacaauaucacagguggacugcacacccucugugauauugaaaauaau

SEQ ID NO: 54160 - RNA, 64 nt, Homo sapiens
auuaggaagcuaauaucuguauccucuaugguuaugagauagaugaagauguugccuuuuuaau

SEQ ID NO: 54161 - RNA, 81 nt, Homo sapiens
auuaggaguaacaggauccaaagaauguauugaacuucauuguuuuaguuggcaucuuugcgagccuuuuaaugaucugau

SEQ ID NO: 54162 - RNA, 69 nt, Homo sapiens
augucuucuuuauuuuuaguauauucuuacuuagaaguuuggagaauguaaacagaauagaggagauau

SEQ ID NO: 54163 - RNA, 86 nt, Homo sapiens
augucuuugcuaaugugaauagugcuguaaugaacauaagcauacaugugucuuuaugacagaacgauuuauauuccuuuggacau

SEQ ID NO: 54164 - RNA, 94 nt, Homo sapiens
augugcugguuuagaguguuagaaauggauauuguauuaguucucuaugcuucauaaugaguuaucacaaacuuagcaguuuaaaacaacacau

SEQ ID NO: 54165 - RNA, 63 nt, Homo sapiens
auguggucugugcaagagugaaaggagcuaaagaugacuccaaaagcuguugucagagcacau

SEQ ID NO: 54166 - RNA, 56 nt, Homo sapiens
auguguacugagcacuuacugugucucaggccuccuccuaagugcuuuaaacacau

SEQ ID NO: 54167 - RNA, 74 nt, Homo sapiens
augucggaggaugcacuuugucaguaaguuaggcauucagucuucacugucaacacaaaugcauucugugacau

SEQ ID NO: 54168 - RNA, 105 nt, Homo sapiens
auguuaaggacccauuguuuggguccuuauugauaccaauggccauaauaaucucuaaauuuauuuauucauuaacagggaccaaagucaauagggccuuaauau

SEQ ID NO: 54169 - RNA, 67 nt, Homo sapiens
auguuccugugauaguuucuguuuugaagaugaaugccuguuaucacagaggguauccuagagauau

SEQ ID NO: 54170 - RNA, 72 nt, Homo sapiens
auguucucaucacuucaagcagauacccucuucuucuuucucacugggaucaaagugaauuaaugagaauau

SEQ ID NO: 54171 - RNA, 63 nt, Homo sapiens
auguugaaccagccuuguauuccuggaaugaauccuaccuggaaugaaaccugguuaugauau

SEQ ID NO: 54172 - RNA, 83 nt, Homo sapiens
auguugcaguuuaauuauccuauugaaaauguguuaaacgcucccaaguacaucaugaauaaggauuauuaaauuugcagcau

SEQ ID NO: 54173 - RNA, 67 nt, Homo sapiens
auguuuacaguauugcaaggacuaggaaaucccucauugauaccaguccugccagucuugucaauau

SEQ ID NO: 54174 - RNA, 69 nt, Homo sapiens
auuauuggucuaugcaagauuucuaugucucccugauucaagcuugggaguuuguauguuuccaguaau

SEQ ID NO: 54175 - RNA, 70 nt, Homo sapiens
auuauuuuggcucugucuguaucuuugcucuauuccuauuugagcaaagacagagagaagccagaacaau

SEQ ID NO: 54176 - RNA, 70 nt, Homo sapiens
auucaccauuucuugcugaaacaaauaaaccagaauuaacuguguaucuauucagcaaaggaaugggagu

SEQ ID NO: 54177 - RNA, 59 nt, Homo sapiens
auucagaggggcagcugucuugggccccagugguuucccagaucccuguuccucugaau

SEQ ID NO: 54178 - RNA, 99 nt, Homo sapiens
auucagcuuauaauccauuauuaucacuguuuugaugcucggacgcucugagacgauccgggcaucaaaacagugauaguaaugcauuauaagcugaau

SEQ ID NO: 54179 - RNA, 60 nt, Homo sapiens
auuccauuuguuaucacacccguauaaacacccauuuugaugggugggccacaguggagu

SEQ ID NO: 54180 - RNA, 82 nt, Homo sapiens
auucuccuagcugcacuuccugcuacugggaagggugggguugcuuuccuggggagcaguaguaggcaggcagcuggagaau

SEQ ID NO: 54181 - RNA, 70 nt, Homo sapiens
auucuguauaauuauagcuguucaggguauuuugguuuugcauggauaucccagugaugauugauaggau

SEQ ID NO: 54182 - RNA, 82 nt, Homo sapiens
auucuuuuguucucuauuguacauguuauagauuuuuaaguugucuggaagucaagaugcauaugcaaguauacaaaagggu

SEQ ID NO: 54183 - RNA, 67 nt, Homo sapiens
auugaguacuuagugucauauacuaggaauuuccuuugguauuuucaugugcacuaugucauuuaau

SEQ ID NO: 54184 - RNA, 80 nt, Homo sapiens
auugcaaguguccuuccaugagugagugaauugcuaaacaaacgguaaugcacucgaaucauggaauauuauucagcaau

SEQ ID NO: 54185 - RNA, 65 nt, Homo sapiens
auugcauguucuuacucauacaugggugcuaaaaaauguguucauguggauguagagaguggaau

SEQ ID NO: 54186 - RNA, 68 nt, Homo sapiens
auaguaggaauuugguaaauauuuguugaaugagugaauagauaaauggauaaaugaauaccuacugu

SEQ ID NO: 54187 - RNA, 77 nt, Homo sapiens
auagugcugcaaacaugagaggaagugcagauaccuaucucuuugauacaccaauuuccuuuccuuuggguauauau

SEQ ID NO: 54188 - RNA, 107 nt, Homo sapiens
auaguguaguagagcuaggaggagaggguccuggagaagcguggaccgguccggguggguuccggcagguucucacccucucuaggccccauucuccucugcacugu

SEQ ID NO: 54189 - RNA, 89 nt, Homo sapiens
auaguuaauggcucagcuaugaaauggaccgucaugcaaugucuaagacauuugcaaagaccucuucacuuccauggagucauaauuau

SEQ ID NO: 54190 - RNA, 101 nt, Homo sapiens
aguuuauucuuucaugugcauuuuagaaaaucagcgugucaaauccuucaaggguucuguuuggauuuggcagcugcuucaugggaugcgaagguuaaacu

SEQ ID NO: 54191 - RNA, 66 nt, Homo sapiens
aucagaaucucuagaggacuguccagggaauguuuauuuuucaaaccuccuccaggggauacugau

SEQ ID NO: 54192 - RNA, 63 nt, Homo sapiens
aucagaaucucuagugggaccaagagaucuauauuuuaaacaaguacccuaggugauucugau

SEQ ID NO: 54193 - RNA, 75 nt, Homo sapiens
aucaugcacuuggcaggaugauucccaauuggggagauuucgccccucaggggacaccuggcaaugccuagagau

SEQ ID NO: 54194 - RNA, 55 nt, Homo sapiens
aucagugcauguuuguugagcuaaacuuuuaucucaccgacgaggcugcacuggu

SEQ ID NO: 54195 - RNA, 69 nt, Homo sapiens
auccuuuggaggauccugagcugauuacuggaagggccaguggauaguaaagucagauucccagagggu

SEQ ID NO: 54196 - RNA, 81 nt, Homo sapiens
aucauugccaucacuagaucauagguaaacacuacugaaugcuucagacgugauuaccugggaucuagugacggcagugau

SEQ ID NO: 54197 - RNA, 70 nt, Homo sapiens
aucguuugaaccugggaggcagagguugcaguuagccaaaauugcacuacugcacucccaccugggcgau

SEQ ID NO: 54198 - RNA, 96 nt, Homo sapiens
aucuauaaaauggggauuuauauuuaucucuuaugauauaaggaugguaaaaaauagcucaucauggagaugauuaugaaucacuuauauguggau

SEQ ID NO: 54199 - RNA, 111 nt, Homo sapiens
aucucaacuaaguacaucugugaagauccuguuuccaaaucaggucacauuuugagguucuagguggacaugaauuuuggaggcauacuauucaacucaguauguggagau

SEQ ID NO: 54200 - RNA, 61 nt, Homo sapiens
aucucaguuaauuccaucuuuccagcuacacaugcuagaauccuuggaguuauacuuggau

SEQ ID NO: 54201 - RNA, 56 nt, Homo sapiens
aucuccaaauacagucauauuagggguuagggcuucaacauaugaauuuuggagau

SEQ ID NO: 54202 - RNA, 97 nt, Homo sapiens
augacacuaaguucuaggguacaugugcacaacaugcagguuuguuacguauguauacuugugccauguugguauguugcacccauuaacucgucau

SEQ ID NO: 54203 - RNA, 64 nt, Homo sapiens
augacccccauuucuggagcuaauccuggaauuaacauuacccuuagacuccagagugggucau

SEQ ID NO: 54204 - RNA, 86 nt, Homo sapiens
aucuguacuuuaguguaauugauagguucuaagcagguguugugccugcagcaccuagcacagugccuggccugaagaaggcagau

SEQ ID NO: 54205 - RNA, 102 nt, Homo sapiens
aucuuauuauauauuauuguuaaucucuuacuaugucuaauuuacaaauuaaacuuuaucguagguauguauguaugggagaaaacauaguauauuuaaggu

SEQ ID NO: 54206 - RNA, 65 nt, Homo sapiens
aucuucaagguuaaaguucgccugugagcauacaccuguaaucacagagguuuggccucaaaggu

SEQ ID NO: 54207 - RNA, 57 nt, Homo sapiens
aucuuuaguggcuguuuucagagagaagcaccuucaccaaacagccuagcuaaggau

SEQ ID NO: 54208 - RNA, 72 nt, Homo sapiens
aucuuuauagcagugugaaaauggacuaauucaguaaauugauagcacagaguggggcgcugcuauaaagau

SEQ ID NO: 54209 - RNA, 71 nt, Homo sapiens
augaaaagugcuuuguacagggguugaacaauguaauggaaguuggucaucucaauuaaaagcaauuucau

SEQ ID NO: 54210 - RNA, 61 nt, Homo sapiens
augaaaucauguaguuauugcaagauugcaauuugucuuugcauauauuucaugguuuugu

SEQ ID NO: 54211 - RNA, 65 nt, Homo sapiens
augaaaucuuuggcagaucuuauguacagaaugguacuuccuagguuauuguccaggguuuuuau

SEQ ID NO: 54212 - RNA, 59 nt, Homo sapiens
augaagacaucgucugggauuaucuggggagcccuaauuccaaugacagguguccuugu

SEQ ID NO: 54213 - RNA, 66 nt, Homo sapiens
augaaguuuucuggagugugaaguggauaugucuuauaaguuuaauucacagcuucaccacuucau

SEQ ID NO: 54214 - RNA, 56 nt, Homo sapiens
augaauacugcugcaaugaacauaugagugcaugugucuuuuggguagugauuuau

SEQ ID NO: 54215 - RNA, 90 nt, Homo sapiens
augcaggcagaggaaacagaggugccacaauaucaucuguuugcaucuggauucuauauugccuugccuacuuuuccaucucaccugcgu

SEQ ID NO: 54216 - RNA, 83 nt, Homo sapiens
augcauguguuaguuuggaagacauucugucugcuagaaguucugcuuauaguuguauaaugucuuucauaacugauaagcau

SEQ ID NO: 54217 - RNA, 71 nt, Homo sapiens
augagugaaugaauguuuauccuuagauuuuagaaauuaaaggagaggaacauacauuuuaaugcacuuau

SEQ ID NO: 54218 - RNA, 81 nt, Homo sapiens
augauucaguuuuugaugugcucaguuuggaaggucgguuagacuuccaugugggcuugucaaguaggcagcuggggucau

SEQ ID NO: 54219 - RNA, 55 nt, Homo sapiens
augauuccacuuucuaagaggggcuacucuagauacuucacagaaguggaaucau

SEQ ID NO: 54220 - RNA, 59 nt, Homo sapiens
augagauacuacaaaugaguuuccgguuuccggauccaaucaccuuuguugguauucau

SEQ ID NO: 54221 - RNA, 76 nt, Homo sapiens
augagauauguuaaaaguuaaaaauacagcuguugguaauguguuguaaugaaacuaacuuuugugccuaucuugu

SEQ ID NO: 54222 - RNA, 55 nt, Homo sapiens
augagaugaggaauggcccuccaggagagccagaggcuauuuccacucuucucau

SEQ ID NO: 54223 - RNA, 65 nt, Homo sapiens
augagauuugggaggggccaggaguggaauaauaugguuuagcuuuguccccgcccagaucucau

SEQ ID NO: 54224 - RNA, 65 nt, Homo sapiens
augagauuugggaggggucagagguggaauaauaugguuuggcuuuguccccacccaaaucucau

SEQ ID NO: 54225 - RNA, 66 nt, Homo sapiens
augagauuuggguggggacacagagccaaaacauaucauuuuguuucuggccccucccaaucucau

SEQ ID NO: 54226 - RNA, 78 nt, Homo sapiens
augaggaagagagaaaagugugugcagagggcaggaagaaagcccaagcucugugcauuacacuuuucucagucucau

SEQ ID NO: 54227 - RNA, 56 nt, Homo sapiens
augagggaagcucacguguccaccuggcaauugguaggagcaucugguuuccccau

SEQ ID NO: 54228 - RNA, 60 nt, Homo sapiens
auuuaccuaugaguuuguguuaguugaaacaauuggcagaaaucuuuauaguaaguaaau

SEQ ID NO: 54229 - RNA, 65 nt, Homo sapiens
auuuagagggaagagcaguguguugagaagaauuagguucaacagaacugggcuugcuuuuggau

SEQ ID NO: 54230 - RNA, 81 nt, Homo sapiens
auuuagaugacagagguaagcaagucagcauuaaaaucauuuaugguguuucuaaagcauuguccuguguuuaagcuaaau

SEQ ID NO: 54231 - RNA, 128 nt, Homo sapiens
auuuauaucccccucuccacuuuucaugcuacuuauuuguggaagaaaucagguuauuuguccuguagaguuuugcagucuagauuuugcugaauuuuucccuagcaagcauacucagauggaaaaau

SEQ ID NO: 54232 - RNA, 107 nt, Homo sapiens
auuucaccaccaucauuaacacugccauugauacugucaucucugccacacgauuaauauugccaaugagacaguuagugcagccauguuaacacugccuuugagau

SEQ ID NO: 54233 - RNA, 128 nt, Homo sapiens
auuuccucuuuugauugguuacuuuuauggagagauauuuaugguuuuaauaagauuucccucccaucuguuuugauccuaccguaaaaucaucccauguuugaugggcagccgguuguuagggaaau

SEQ ID NO: 54234 - RNA, 59 nt, Homo sapiens
auuucuccuaggaguaucaauacaagguguugacaacugauuaacuccuuuagagaagu

SEQ ID NO: 54235 - RNA, 69 nt, Homo sapiens
auuucugcagcuaaggacccccugguugccucuguggcccagcaaucacaggucuuggcugcaugaaau

SEQ ID NO: 54236 - RNA, 60 nt, Homo sapiens
auuucugcuggcagguguguuauaaagguguuuggucuucuuggcaaugucagcagagau

SEQ ID NO: 54237 - RNA, 79 nt, Homo sapiens
auuucuucugacaggaaacaugcagugauuaauaaaagcgccuccuugagcacugauuuauuuuugucucugaaggaau

SEQ ID NO: 54238 - RNA, 64 nt, Homo sapiens
auugugaauagugccacaauaaacauaugugugcaugugccuuaauugcagcaugauuuauaau

SEQ ID NO: 54239 - RNA, 64 nt, Homo sapiens
auugugaauagugccgcaauaaacaugcgugugcaugugucuuuauagcagcacgauuuauagu

SEQ ID NO: 54240 - RNA, 64 nt, Homo sapiens
auugugaaugaugccgcaauaaacauacgugugcaugugucuuuauagcaacaugauuuauaau

SEQ ID NO: 54241 - RNA, 64 nt, Homo sapiens
auugugaaugaugucgcaauaaacauacgugugcauguguuuuuauaacagcaugauuuauaau

SEQ ID NO: 54242 - RNA, 64 nt, Homo sapiens
auugugaauggugccacaauaaacauacauguccaugugucuuuauagcagcaugauuuauaau

SEQ ID NO: 54243 - RNA, 64 nt, Homo sapiens
auugugaauggugccacaauaaacauacgugugcaugugucuuuauagcagcaugauuuauaau

SEQ ID NO: 54244 - RNA, 64 nt, Homo sapiens
auugugaauggugccgcaauaaacauacgugugcaugugucuuuauagcagcaugauuuauaau

SEQ ID NO: 54245 - RNA, 64 nt, Homo sapiens
auugugaauggugccgcaguaaacauacaugugcaugugucuuuauagcagcaugauuuauaau

SEQ ID NO: 54246 - RNA, 64 nt, Homo sapiens
auugugaauggugccucaguaaacauacgugugcaugugucuuuauagaagcaugauuuauaau

SEQ ID NO: 54247 - RNA, 64 nt, Homo sapiens
auugugaauggugcugcaguaaacauacgugcgcaugugucuuuauagcagcaugauuuauaau

SEQ ID NO: 54248 - RNA, 67 nt, Homo sapiens
auugugugaaccuucuagaaucagacauauuugcaaaagauugucauugcuuaaggguucaugcaau

SEQ ID NO: 54249 - RNA, 129 nt, Homo sapiens
caaaacgaugagguugaguguguguguguguaaccuagaaucuaggucuucuuagauugaaaaucaucgcaguucuaaggaacucugauaucuggaaaaauccauacucaggcaccaaucagucauuug

SEQ ID NO: 54250 - RNA, 57 nt, Homo sapiens
caaaagugguucuuauccuuuuauuuucucuucuuagaggagacagaaaagcuuuug

SEQ ID NO: 54251 - RNA, 129 nt, Homo sapiens
caaacacaaucagcaucaccuggaagguuuugagaaugcagaaucucgugcaccaucccagauccacugaaucagaaucugcauuuuaaacaagacuccccagguaaauuauaugcauauuaauguuug

SEQ ID NO: 54252 - RNA, 130 nt, Homo sapiens
caaaccugaaaauccaaaaugcuccaaaaucuaaaacuuucugagugcagcaugaugacucaaagaaaaugcccacuggaguuugcuagaaacguuuugcagcauuuugaaucugugauuuuuggauuug

SEQ ID NO: 54253 - RNA, 94 nt, Homo sapiens
caaagaggccauggauuacugugauauaucuacuucagggaaacuuuacaauucugaaagagcauguaacacaguaacccacaguuuuucuuug

SEQ ID NO: 54254 - RNA, 90 nt, Homo sapiens
auuuuguuaggacacauugcaggaaaguucauuauucuaggccuucaacagaauaaucuuagcaaccuccagugugauagagaacagagu

SEQ ID NO: 54255 - RNA, 77 nt, Homo sapiens
auuuuuaaauauaugcauuaauaaagggcucuacaauucccuggaguauacuuggagugaugcaaaucuuuaaaagu

SEQ ID NO: 54256 - RNA, 57 nt, Homo sapiens
caaaggcuucugaaacugcagagauaucauugcuaugcaagaaacccagagccuuug

SEQ ID NO: 54257 - RNA, 63 nt, Homo sapiens
auuuucacuguauuguggaagaauacagaaagaagaaacacuuuucuacagucacaggaagau

SEQ ID NO: 54258 - RNA, 71 nt, Homo sapiens
auuugugccuuuucugagcaaugagcagagcacuguguguguggccauagugucaggaaagggucgcaagu

SEQ ID NO: 54259 - RNA, 60 nt, Homo sapiens
auuuuacaaagugggaaacgaagguuccucuuaggaaccuaguugucaccuuuguauaau

SEQ ID NO: 54260 - RNA, 57 nt, Homo sapiens
auuuggaaaaauccaccuugaucucauagcaaaccugagaugguggcuguuucaagu

SEQ ID NO: 54261 - RNA, 88 nt, Homo sapiens
caaagugacagcgauucuggcuugugaacugucuucucacuugggacugagauuaacagcauacaggucaauuauugcugucauauug

SEQ ID NO: 54262 - RNA, 77 nt, Homo sapiens
caaguagauuuuuuauauggucaauauuguuuccauuucuaagggcauaauagcugaucauuuagaaguaucacuug

SEQ ID NO: 54263 - RNA, 83 nt, Homo sapiens
caagauaaugaaaguuaaguauuuagcaugaugccuggcaccugacgggugguccaggaauguuaguacuucuuaguguuuug

SEQ ID NO: 54264 - RNA, 68 nt, Homo sapiens
caagcacaggggauuuaucagggcagugaaacuaguaugguaauacuguaauggugguuccgugcuug

SEQ ID NO: 54265 - RNA, 66 nt, Homo sapiens
caauuuaguaaauuuuucaucuugccugcacuuaaagguuggcuaugaagucguuacuaccaauug

SEQ ID NO: 54266 - RNA, 64 nt, Homo sapiens
cacaaaauuccagguggcgccauucacaugguggccauuaugaauggcaccaccuaggguugug

SEQ ID NO: 54267 - RNA, 65 nt, Homo sapiens
cacaaagaguuuguagaaacuccauaguacucaaaagguuacaaguggguuugugcaggagugug

SEQ ID NO: 54268 - RNA, 91 nt, Homo sapiens
cacaaauauuugcuccuguguuauaauugccuacaguauucaacagaguaacauacuguauaggauuguagccuaggagcaauaggcugug

SEQ ID NO: 54269 - RNA, 82 nt, Homo sapiens
cacaaugugguugaaagagcauggacuugaaauucaggcuggucugguucaagucuuggcuuugccaccuacuaaccaugug

SEQ ID NO: 54270 - RNA, 71 nt, Homo sapiens
cacaauugaagggagaaauggacugaagcacaauaauacuaagagauuucaguacuccacuuucaauagug

SEQ ID NO: 54271 - RNA, 72 nt, Homo sapiens
cacaauugucagugcuguuuaaauuguauccucucucucucuuaauugaacuuuugucacugacauguugug

SEQ ID NO: 54272 - RNA, 97 nt, Homo sapiens
cacacacacauauauacauauauaugcacuauacacacguauauauauauauauauauacguguguguauguaugugugugugugugugugugugug

SEQ ID NO: 54273 - RNA, 55 nt, Homo sapiens
caagugaauaguugcucucagauaaauagaauauaggaaggcauggguuuacuug

SEQ ID NO: 54274 - RNA, 60 nt, Homo sapiens
caagugaaugaugugaaguguaaacaaccaucuauguuucauguuacugucauacacuug

SEQ ID NO: 54275 - RNA, 63 nt, Homo sapiens
caagugaaugaugugaaguguaaaccaaccauuguuguguuucauguuacugucauacacuug

SEQ ID NO: 54276 - RNA, 93 nt, Homo sapiens
caauaugaagaaaaagucaagaaucucagcaucuuuggcucugacaucauagauggaaaaggcuugguucuuugaugacauuuuugaguauug

SEQ ID NO: 54277 - RNA, 78 nt, Homo sapiens
caauguuaauacugagaugugagguacuaucccagccaucauguugauuguuaccuggauauuuuguguucuccauug

SEQ ID NO: 54278 - RNA, 84 nt, Homo sapiens
caauucuggucuuuaugacugcaaagcauauacucuuaacccaaacuggaagauauguuaguuauaaacucuuugccggaagug

SEQ ID NO: 54279 - RNA, 66 nt, Homo sapiens
cacagaauucauuggauuaccuauugggacaaaucaauucuagccauguaaaccagugagucugug

SEQ ID NO: 54280 - RNA, 78 nt, Homo sapiens
cacagggcuaucccagaaacucggguuucucuugagaugccagcugagacucccgucuucucuguggaaagcccugug

SEQ ID NO: 54281 - RNA, 103 nt, Homo sapiens
cacagucucagguaguaucuuuauagcagugugaaaacagacugauacagagaauugguaucaggaguuugggguacugcuauaaagauaaacugaaaaugug

SEQ ID NO: 54282 - RNA, 61 nt, Homo sapiens
cacaguguucauagccaucaggaacuuggaaaacaaacuuuggugaaugcgagcaacugug

SEQ ID NO: 54283 - RNA, 101 nt, Homo sapiens
cacaguugagcacuuuuagacacuagcugcaaagggagagaugauugauucauuauuaaucucuuccaaccuuugucuauggcgggaacgugcuaccugug

SEQ ID NO: 54284 - RNA, 57 nt, Homo sapiens
cagaacugaccucugauucuaggacugaccucugacccuggaacugauucaguucug

SEQ ID NO: 54285 - RNA, 83 nt, Homo sapiens
cagaacuguguuuucauugguuaaucaccgguguccagugaucuguccuucauagccugugaaaauuuauaacauccuuucug

SEQ ID NO: 54286 - RNA, 68 nt, Homo sapiens
cagaagagagcaagauuguucccauuuucuauuuuucuaguaggaauuaucuucaucuugccuuucug

SEQ ID NO: 54287 - RNA, 65 nt, Homo sapiens
cagaagcuggugccccgggggcaguuggacagcccauggacauccccgggagcaccagcuuguug

SEQ ID NO: 54288 - RNA, 74 nt, Homo sapiens
cacuugauuccgaaaugaggcuuuugcagacguaauugaggaugucaagaugagaucauucuggaauuagagug

SEQ ID NO: 54289 - RNA, 91 nt, Homo sapiens
cacuuuacacuguaucuuccuccaggcaauugaguuauuuggaaccagcuaggggucagugucugugauggagaggugcagucuugaggug

SEQ ID NO: 54290 - RNA, 110 nt, Homo sapiens
cagaaagacacugcuuggaggcagggacuccugagacucacaggcuccccagcacggccacuggggacacaggccaguccaggggccccagcccuuugguucccuuucug

SEQ ID NO: 54291 - RNA, 88 nt, Homo sapiens
cagaaagggugcggccuggcugacagcuuaauuccagcuuuacgaaacccugaguagagaauucagcuaaggugagcccagauuucug

SEQ ID NO: 54292 - RNA, 66 nt, Homo sapiens
cacuagaaugucagcuucuugagggcagagauuuuuaucuguuuuccagcuguugcauucccagug

SEQ ID NO: 54293 - RNA, 73 nt, Homo sapiens
cacuguaauucuuggggcugcucugacaauuaacaaacacaaauguccacguagcaccuuagcauuucuagug

SEQ ID NO: 54294 - RNA, 65 nt, Homo sapiens
cacuuccugaaauggauuuggugauacuucucauugaggugucaugaacucacauucugggggug

SEQ ID NO: 54295 - RNA, 74 nt, Homo sapiens
cagaaugagacuaagugacauugugcccauuugagcuuacaccuuaagaggccuugugugcauuuucucuuuug

SEQ ID NO: 54296 - RNA, 73 nt, Homo sapiens
cagacacguggagaugguugacaaauguugcccgaaaauuugggaucuuggcaaucaauucugacgucuucug

SEQ ID NO: 54297 - RNA, 64 nt, Homo sapiens
cagacaugggacauagauccuugagguuucuggugaaaucugcacaucuguguuuuuguaucug

SEQ ID NO: 54298 - RNA, 83 nt, Homo sapiens
cagacucccaggcccacuagaacuagaacugcugggguaggaccugcccacaagcaucuuuuuagccuucucuggugauucug

SEQ ID NO: 54299 - RNA, 79 nt, Homo sapiens
cagacuggggagagaaaucaaaaccugaacaccaauauggcagugaguuuacugguuuuauauauuucucccaaaucug

SEQ ID NO: 54300 - RNA, 77 nt, Homo sapiens
cagagaagauaugcauauauuuauacauuuauguacauaacaucacuguguauguauaugcaggguguuuuacuuug

SEQ ID NO: 54301 - RNA, 95 nt, Homo sapiens
cagagaggaugagagacaugccuaggguugcacaguccauagcagggaagucaguguucaaacccaggucugucugaugcccauacccuugacug

SEQ ID NO: 54302 - RNA, 81 nt, Homo sapiens
cagagaucuaauuuaccauuuacuuuuuaaugacaaugguaaguuuuucugucauguaaagaguaaauggugacuuuucug

SEQ ID NO: 54303 - RNA, 108 nt, Homo sapiens
cagaguugauuccagaauggaauauguguaaagaguucacauuuguuguaucuuaguugguauuccacaauaugauuuuuaauagaucuuucauuuugaucucaucug

SEQ ID NO: 54304 - RNA, 64 nt, Homo sapiens
cagauauagcuaugggauguauuugcaagacagaacuuagcugaacuugcauagcuguuuccug

SEQ ID NO: 54305 - RNA, 95 nt, Homo sapiens
cagaucaacugucauaucacagugcuuguguucagguaaccuuuauuuuacuaauaauggccccaaagcacaagagcagggaggcaguugauuug

SEQ ID NO: 54306 - RNA, 83 nt, Homo sapiens
cagaugaucucaugugcuguuagaggaaguguaaauuagucaacacuuucuggagcugcacauauucugauuuauccaaucug

SEQ ID NO: 54307 - RNA, 76 nt, Homo sapiens
cagaugauuuucucuuaagugcuuuuuagauaugguuuugucaaaugguaaaauagaauguauuaaagagaaucug

SEQ ID NO: 54308 - RNA, 75 nt, Homo sapiens
cacgaugcaaaugcuucacaucucuggugauuugaauugaaucacacuugauguugagcaacacaccugcuugug

SEQ ID NO: 54309 - RNA, 67 nt, Homo sapiens
cacucuggcaggccgaggcagguggauuaccugaggucaggaguucaaaucgagccuggccauggug

SEQ ID NO: 54310 - RNA, 92 nt, Homo sapiens
cacugagccgccugcauggaggaggggcgccugcacucugugucuuuggccggauguggcacuugacuuucucgcaccuguggcacucagug

SEQ ID NO: 54311 - RNA, 63 nt, Homo sapiens
cacugagcugauagaauuccaguuagaaagcaaagaaacuuggcauuuuaguuagcuucagug

SEQ ID NO: 54312 - RNA, 87 nt, Homo sapiens
cacugaguauauauguuuguuuagaugguaaaucaguauugagauauacuggacuuaaugaugaauuguauauacaaauauucagug

SEQ ID NO: 54313 - RNA, 108 nt, Homo sapiens
caccugcauugcccugaaccagcuggcucguguuuucuguccaguuccugcugguaggcaaggcugggcugggcagggcuaaugcuggggcagaaggcuuuccaggug

SEQ ID NO: 54314 - RNA, 60 nt, Homo sapiens
caccuggcuauucccucaaucugggcccuggggccauggcaauguggaaugguccaggug

SEQ ID NO: 54315 - RNA, 114 nt, Homo sapiens
caccacuggcuggcuggaauuccaagccagcaggucuuaacuugugaggugcuguggaaguggggcccacagaacaagacugcuuggcucccuggauucagcccccuuuaggug

SEQ ID NO: 54316 - RNA, 57 nt, Homo sapiens
caaggaaaagaaguauuucagaagcauccugcuuuuuaaaugcuagaauuuucuuug

SEQ ID NO: 54317 - RNA, 64 nt, Homo sapiens
caccauacauucucuauaagugcauguguguuuacauaaaugcacagaaaggauguggaaggug

SEQ ID NO: 54318 - RNA, 72 nt, Homo sapiens
caccauuauaaauugacuuauuugcuuucaaaucucacuggaaaauagcagagcaguggauuuugugaggug

SEQ ID NO: 54319 - RNA, 107 nt, Homo sapiens
cacccgaugcccccuuagacuguuguaaugcacagcuggucauuuaagagcccugagaaguccuuggaucauggaguauuugcaagucuaacgggaggcacuuggug

SEQ ID NO: 54320 - RNA, 76 nt, Homo sapiens
acuuaguaguaucuuaggccuucaguggaaggaaacagcauguuccacgcccuguagcauccaagaagcugcaagu

SEQ ID NO: 54321 - RNA, 62 nt, Homo sapiens
acuucauagcaaagagcauaaaagucaucagucagugacuagguaugcuauuuauuagaagu

SEQ ID NO: 54322 - RNA, 56 nt, Homo sapiens
agaucuggaagccacuguuucgaaggcaggucagucuuuugaauaguguccaaucu

SEQ ID NO: 54323 - RNA, 100 nt, Homo sapiens
agaugcuuuucaaaauagaggucaucuucuuggagauuucuucuuaaugguaacuucuaaagauguuaaaagcuaucuccaaggucaucucagggcaucu

SEQ ID NO: 54324 - RNA, 76 nt, Homo sapiens
agaggaaucaucacacugucuuucagaaugguugaacuaguuuacauucccaccaacaguguaaagguguuccuuu

SEQ ID NO: 54325 - RNA, 76 nt, Homo sapiens
agagggaaauaugucuguuuagucuguaaugaugcauauuuucauacauaaaauaaauaggucaucaaaucucucu

SEQ ID NO: 54326 - RNA, 73 nt, Homo sapiens
agagguaagcaguggcaagugcugggcccagaaccaacacuugguugucagcugcuuaguccaaguauccucu

SEQ ID NO: 54327 - RNA, 56 nt, Homo sapiens
agagguuuuggggcugagagcuuggugggcacgggcugccagcugucccggcuucu

SEQ ID NO: 54328 - RNA, 58 nt, Homo sapiens
agagucuaguauuaaaaucacacuguguaguuuaauuccacuuuaaugcuaggacucu

SEQ ID NO: 54329 - RNA, 85 nt, Homo sapiens
agagcaauauuuuuggugcaggagcugacucaucagauuagcagccucucaagauugaugauguuucugccuugccuauuccucu

SEQ ID NO: 54330 - RNA, 84 nt, Homo sapiens
agagcacuccuucaacaggucaauugcauagaaucccugucuugggcucugcuucuagggcaguugaucugaaacaguagcuuu

SEQ ID NO: 54331 - RNA, 61 nt, Homo sapiens
acuguaaggcauuucucagacuccagccagaaacugacacaaauggcaagugccauacggu

SEQ ID NO: 54332 - RNA, 65 nt, Homo sapiens
acuggauguuagggauuuuauuguaucacuuccaaaauguauauguugaaguccuaaccuccagu

SEQ ID NO: 54333 - RNA, 58 nt, Homo sapiens
acuggcauggcaccauagugagaggaaggggguucuuucuugggcaugcuaugucagu

SEQ ID NO: 54334 - RNA, 64 nt, Homo sapiens
acuugggucuggaaggucgaugcugcagugagccaugauugcgccauugcauuccagccugggu

SEQ ID NO: 54335 - RNA, 79 nt, Homo sapiens
acuugguaccuuuuaaugacuaauuaauauaguggacucauuaaauagguggacauuaauaggguacuuaauguggagu

SEQ ID NO: 54336 - RNA, 88 nt, Homo sapiens
acuuggucaucaauuacugagagaggaauauugaaaucuguuacuguaauuguggauuugucuguuucuccuuguaguucuaucaggu

SEQ ID NO: 54337 - RNA, 96 nt, Homo sapiens
acuuugauuaucauagauuuguaauauguuuugaaaucaggaaauguaaguccuccaacuuuguucuuuuucaaaauuguuuugacuauucggagu

SEQ ID NO: 54338 - RNA, 65 nt, Homo sapiens
acuuuguugaaaugaauuaaguguagagucuuguaccacuucaccuucauucauucagcugaagu

SEQ ID NO: 54339 - RNA, 69 nt, Homo sapiens
acuuuuuguggaagauaguguguuaaugugacaaaaauuacaaauguacuuuucuuuccauccaaaagu

SEQ ID NO: 54340 - RNA, 70 nt, Homo sapiens
agaaagaauacaagcaggaaaugguauauguaguagucuuauuuuucuuuccuaguuuguuuaaauuucu

SEQ ID NO: 54341 - RNA, 129 nt, Homo sapiens
agaaauaaacaguaaguacaaguuaaugguugucuugagagaggacaugacugaggagaaauacacaaguauuaguuaaggucuguuucuuaagaugaguaguggaccuauauugucuguuuuaguuuu

SEQ ID NO: 54342 - RNA, 59 nt, Homo sapiens
agaaaucuauguuuugguuagauguauuuuuucaucuuuuauagaauauaggucauucu

SEQ ID NO: 54343 - RNA, 85 nt, Homo sapiens
agaaaugaguuuaaaugguagucguuucaguuaagaucuaagaaagacuuugggaaugaguuuaucauuuauuauaauuauuuuu

SEQ ID NO: 54344 - RNA, 61 nt, Homo sapiens
agaaauuaaacggcucugcugugcucuuccaaucuauugagaacagcugguuuugguuucu

SEQ ID NO: 54345 - RNA, 70 nt, Homo sapiens
agaacacuaguauuccuuuugcauuuccacauagcuauagagugagaagauaaggggauaauggcguuuu

SEQ ID NO: 54346 - RNA, 130 nt, Homo sapiens
acugcaaccuuccccuccugguucaagcacgucuucugucucagccucuccaguagcugugacuacucagaggcuacucagaaggcugaggcaggagaauugcuugaaucugggagguggagguugcagu

SEQ ID NO: 54347 - RNA, 109 nt, Homo sapiens
acuaguagugggauugcugggucaaaugguaguucuauuuuaaguucuuugagcaaucuucaaacugcuuuccaugguggcugaauugauuuacguucccaccaacagu

SEQ ID NO: 54348 - RNA, 86 nt, Homo sapiens
acuagugaguuuguuuaccugauuuguggccaauuugagucugauuaagaaucuuaaaguguuugcagacaggugguaaaauuggu

SEQ ID NO: 54349 - RNA, 59 nt, Homo sapiens
acucaaauagcaacggugagaagcucaggcugccauuaauuucacugugugucuugggu

SEQ ID NO: 54350 - RNA, 86 nt, Homo sapiens
acucagcagucaggggagauggcaaugcgaugaugacugagugucuuagucuuuuuuguauugcuaugcaauaucugaggcugggu

SEQ ID NO: 54351 - RNA, 86 nt, Homo sapiens
acucagcagucaggggagauggcaaugcgauggugacugagugucuuagucuuuuuuguauugcuaugcaauaucugaggcugggu

SEQ ID NO: 54352 - RNA, 70 nt, Homo sapiens
acucagggugaugguugaaugaauuaugggacauuugucucauggaauacuucacagccacuaaaagagu

SEQ ID NO: 54353 - RNA, 59 nt, Homo sapiens
acuccauuuggaacagauguccugcccuucaucucuccagggccuuggccagauggggu

SEQ ID NO: 54354 - RNA, 130 nt, Homo sapiens
acuccuggccucaaguaauccaccugccuuggccuccgaaagugcugggauuggcugggcgugauggcucacgccugcaaucccaauacuuugggaggccgaggcggguggauugcuugaggcuaggagu

SEQ ID NO: 54355 - RNA, 98 nt, Homo sapiens
acucgaaauuaaacauggugcuugccuuucaagaggcuuucaggccaacaagguuuggacuucucaaggcaauaaaugcauugucuuuaaucaagagu

SEQ ID NO: 54356 - RNA, 55 nt, Homo sapiens
acucuaacacugagcaaagaaaauuagaauauuuucaugucuuggcuguuagagu

SEQ ID NO: 54357 - RNA, 66 nt, Homo sapiens
acucuuugugaggagugaacuauuucugauucccuuuuagucaaagguauagcuuuucaagagggu

SEQ ID NO: 54358 - RNA, 70 nt, Homo sapiens
acugagacugagaauguuucuugggucauagauucccauugucagcuuacagcauucuuagugucucagu

SEQ ID NO: 54359 - RNA, 61 nt, Homo sapiens
acugagaucuuuaaauaaauaaauggaauauauaccauggucauggguuggaagacucagu

SEQ ID NO: 54360 - RNA, 61 nt, Homo sapiens
acugaguguugauuuagauuaacuuguugauaauuucuagaugggucagucaggacucagu

SEQ ID NO: 54361 - RNA, 102 nt, Homo sapiens
agaaggggaagaaagagaagcaggauaggguauccuuaacaauacuuaaguuuguaaagaucauaugcuguucuauuuacaauucuuacuuuaugaacuucu

SEQ ID NO: 54362 - RNA, 111 nt, Homo sapiens
agaaggugccauuuaggaauuuuauaacuaaagagaagucaaugucuggguucaaagcuucaaaggacaggcugacucucuuuuuagugguuaaugccgguggugacuuuu

SEQ ID NO: 54363 - RNA, 73 nt, Homo sapiens
agaagugaaauacuuaauuucuccaugcugguuacacugcaccaggaccagggccaauugguacuuuccuuuu

SEQ ID NO: 54364 - RNA, 70 nt, Homo sapiens
agaaucuauauacuguuucucaccuugguggcuccaaucuacauuuccaccaacaguguguaaggguucu

SEQ ID NO: 54365 - RNA, 88 nt, Homo sapiens
agaaugguauaguauaauauucuuugaacaguuuuccugugcauaguaaaauaccuauggaagaauugucggggaugugcuccauucu

SEQ ID NO: 54366 - RNA, 85 nt, Homo sapiens
agaauucagaaauaauucuacugaguguuauuuguucaauaguaauaaaacuguuuguauaggcucaguaagaaucuguccuucu

SEQ ID NO: 54367 - RNA, 76 nt, Homo sapiens
agaauucagcaguauuucuccuacucacacauccgucuauaggcuuucugugagaagaaaaauauggcuguauucu

SEQ ID NO: 54368 - RNA, 123 nt, Homo sapiens
agaauuugcuaggccaugagggcucuacucucaugaaugaauuaaugucguuauuuccagaaugaauuaguugucgugagagugguuccauuauaaaaguaagcucucugguguacaccuucu

SEQ ID NO: 54369 - RNA, 83 nt, Homo sapiens
agaauuuuaugucaguguuuggaaucucaauuucuuaguaaaaacacuauuagaaauuagagacagauagugaaauauuuuuu

SEQ ID NO: 54370 - RNA, 67 nt, Homo sapiens
agaauuuuucagggccucagaguaggguggugugggcuacccuggauucguggccuugaauuguuuu

SEQ ID NO: 54371 - RNA, 69 nt, Homo sapiens
agacacauuccaagcauuacaaugugaugcuacuccaucacauuguuauguaaauguuuugaaguguuu

SEQ ID NO: 54372 - RNA, 65 nt, Homo sapiens
agacagggucuugaucagagcucacugcaauaucaaacuccuggguucaagugauccuccugucu

SEQ ID NO: 54373 - RNA, 77 nt, Homo sapiens
agacucaggaaaauauaguaguugucuucaucugaauggcuaucaugaggaagacugaaauugcuguuccucagucu

SEQ ID NO: 54374 - RNA, 92 nt, Homo sapiens
agacuggagacccagggaagagcugauuuuguugcaguucaaguaugaaguuaaucuuccaacagaauccucuuuuccugggaguauagucu

SEQ ID NO: 54375 - RNA, 83 nt, Homo sapiens
agagauguggcaccuacucauuuuucagcucacuauccauuacaacagggcgugguguuagaaugagaaguuugcauguuucu

SEQ ID NO: 54376 - RNA, 67 nt, Homo sapiens
agagauuauccuggcuucucugugugcacuaaaucuaaucugagcccugaaaagcaggauauuuucu

SEQ ID NO: 54377 - RNA, 64 nt, Homo sapiens
agcugagaucucuugccugaacuccagaguuauacauucaacugcaguuggguaugucucaguu

SEQ ID NO: 54378 - RNA, 99 nt, Homo sapiens
agcugagccuucucuuuggaaaccuuguagccacagguggcgaggaaauuuaagagugcuuggguggcuugauggcacaagguuucugaacaggcagcu

SEQ ID NO: 54379 - RNA, 99 nt, Homo sapiens
agcugagccuuugguuuggaaaccuuguagccacagguggcaaggaaguuuaagagcgcuuggguggcuugauggcacaagguuucugaacaggcggcu

SEQ ID NO: 54380 - RNA, 67 nt, Homo sapiens
agcugaucgcuuuuauguuuaauuuuguuaauaggauuuucuguacacaguaaacuaaaagcuagcu

SEQ ID NO: 54381 - RNA, 79 nt, Homo sapiens
agcugcaggugcauuguuuagaaacacuggguucugagaguuccagcccugcugauuuugagauaauguauugccagcu

SEQ ID NO: 54382 - RNA, 55 nt, Homo sapiens
agcuggcuguagcugcaagucuuauuguccaggagaaacugcagcuguagcagcu

SEQ ID NO: 54383 - RNA, 60 nt, Homo sapiens
agcugggccccagccagcuaugugauuuugcccaggucauacaguauggagggcccagcu

SEQ ID NO: 54384 - RNA, 90 nt, Homo sapiens
agcuagcaugauguuauagagguauuaacaguagaagaauuuauuagcaguaaucucuguguauggucccuuucugauguaaugcuagcu

SEQ ID NO: 54385 - RNA, 130 nt, Homo sapiens
agcuaucauggcauuccugggauaacuuguucauauugugcugucuuugugaugugcuguuggauuuguuagcugguauuuugucgaggacuuuuguaucuauguucaucagggauauuggccuguaguu

SEQ ID NO: 54386 - RNA, 59 nt, Homo sapiens
agcuauugucagcaggcacaugagucaguuaaauaauuuaaagcuuagcuauaguggcu

SEQ ID NO: 54387 - RNA, 70 nt, Homo sapiens
agcuguuguuuuaagauacuaaguuugugguaauuuguuacacagcaauagaaaauuaauacagcaugcu

SEQ ID NO: 54388 - RNA, 66 nt, Homo sapiens
aggaaauccaguuuggaggcuugauguggguuuugaccuggccucagccuuggggcuguuuuuccu

SEQ ID NO: 54389 - RNA, 60 nt, Homo sapiens
aggaaauguuuagcauccacuuuuaaaagcaugaggagaggggagagcuaagcaauuccu

SEQ ID NO: 54390 - RNA, 62 nt, Homo sapiens
aggaacacuuacauacuguuagugggaguguaaccauuguggaagacaguguggugauuccu

SEQ ID NO: 54391 - RNA, 65 nt, Homo sapiens
aggaagauaauuucagaaaagugauacgaacgugauaucaaaguuucccagaaguugucuauccu

SEQ ID NO: 54392 - RNA, 67 nt, Homo sapiens
aggaagucucucaaaacuggaagggaaagguguuuucuccacaucaauccaguuuuggagacauucu

SEQ ID NO: 54393 - RNA, 63 nt, Homo sapiens
aggaaguuagcaugacuuuccuugguuuaaaagacagacucaggaagguaaacuaacuugccu

SEQ ID NO: 54394 - RNA, 127 nt, Homo sapiens
aggaaguucuuuuguauuaauauuauuaauuuucugagugcuuugauuauaaaaggguguuugauuuugucaagugccuuuuugugugucaauugaaguuauuauguguuuuguuucccuucuuucu

SEQ ID NO: 54395 - RNA, 60 nt, Homo sapiens
aggaauagcauugaaucuaccaauugcuuugggcaguauggccauuuuaaugcuauuucu

SEQ ID NO: 54396 - RNA, 72 nt, Homo sapiens
aggaaugcuuauacacuguugaugggaguauaaauuaguucaaccauuuuagaagacagugugaagauuccu

SEQ ID NO: 54397 - RNA, 72 nt, Homo sapiens
aggaaugcuuuuacacuguuggugggaguguaaauuaguucaaccacuguggaagacaguguggcaauuccu

SEQ ID NO: 54398 - RNA, 72 nt, Homo sapiens
aggaaugcuuuuacacuguuggugggaguguaaauuaguucaaccacuguggaagacaguguggcgauuccu

SEQ ID NO: 54399 - RNA, 72 nt, Homo sapiens
aggaaugcuuuuacacuguuggugggaguguaaauuaguucacccauuguggaagacaguguggcgauuccu

SEQ ID NO: 54400 - RNA, 72 nt, Homo sapiens
aggaaugcuuuuacacuguugguggguguguaaauuaguucaacccauguggaagacaguguggcaauuccu

SEQ ID NO: 54401 - RNA, 72 nt, Homo sapiens
aggaaugcuuuuacauuguuagugggaguauaaauuaguugaaccauuguggaagacaguguggcaauuccu

SEQ ID NO: 54402 - RNA, 65 nt, Homo sapiens
aggaaaagagacuggaagaaaaucacgccaucuguaggcaaugggugguuuuucucuuccuuccu

SEQ ID NO: 54403 - RNA, 80 nt, Homo sapiens
aggagaaugauaugauugugauguuugaguggcaccagaccuuugguuuacuguagugucauaucguaucucagucuucu

SEQ ID NO: 54404 - RNA, 70 nt, Homo sapiens
aggagagggcaagagaccugagugucauucuguuauucaggagacaaaacucugguccuuucuuuuuccu

SEQ ID NO: 54405 - RNA, 93 nt, Homo sapiens
aggagaguaugaugugugaaaggugaaagauuaaaccagugugucuuacugacagauugcaagauuuuuuaucaaucagcauguauuacuucu

SEQ ID NO: 54406 - RNA, 68 nt, Homo sapiens
aggaggaacucagauacuggugacaugaauguguugugcuuauucugugcuccaugucucaaccuccu

SEQ ID NO: 54407 - RNA, 57 nt, Homo sapiens
aggaggaaggggaggaugguuaacuggaagcaacuauuuguccugccuuuuccuccu

SEQ ID NO: 54408 - RNA, 65 nt, Homo sapiens
agcacuucuucagccaacuucuaagaaugcacaaguagcuuccauggaauuaauggagagguguu

SEQ ID NO: 54409 - RNA, 73 nt, Homo sapiens
agcccccagcacauuacaaguacuugguaggcacccaaaauuuauuaaauaucuguaauuuguugauaagguu

SEQ ID NO: 54410 - RNA, 115 nt, Homo sapiens
agcccgcggcuucccuccugcucgcuacuugacacuuugguucaccugaguuucccucgcagagccuggagcugguggccagagagcagaggugggugggcugccacugugggcu

SEQ ID NO: 54411 - RNA, 94 nt, Homo sapiens
agcaggugucugagugagggacagcuaccucgaagcuggcucucaaagagcacaaacuugaaagcuaucucaaaucgcuauuuuggcaucugcu

SEQ ID NO: 54412 - RNA, 129 nt, Homo sapiens
agcauaagccaucuuucucaucuacuuaaugucuagaccuggcaauaaauuuuuguguuguuguuuccaaaguuaaaugaucaaagaucaaaacuuuguugccaucaaagauauuuagaagauugugcu

SEQ ID NO: 54413 - RNA, 55 nt, Homo sapiens
agcauggcauuccuguaaagauucuuaugaggagaguccauuugcugccauugcu

SEQ ID NO: 54414 - RNA, 56 nt, Homo sapiens
agcauuaguugugaagccuuuauuacauguauugaaguuuucauacagacuaugcu

SEQ ID NO: 54415 - RNA, 74 nt, Homo sapiens
agcauuucauaucauuagaucuacuguauggagacaccugugcaauugaucaaauguauaugaacaaggaugcu

SEQ ID NO: 54416 - RNA, 66 nt, Homo sapiens
agcauuuggguuuuacaucaggcuaaggaaaaucuuccauaucccagauuaaaaaucuagguugcu

SEQ ID NO: 54417 - RNA, 57 nt, Homo sapiens
agccacgaccuucuugggagcagugaggaaucuagccugacuccagaguugugugcu

SEQ ID NO: 54418 - RNA, 81 nt, Homo sapiens
agccagaauuacugcaguaaccacuguaggugugugugguguggcuuuagacacuuauuugugguaguguuuauuuugguu

SEQ ID NO: 54419 - RNA, 74 nt, Homo sapiens
agccuuaaguagugugcauguauguaugugcacacguguacauguaugccuguuugcgcauugagagcuaggcu

SEQ ID NO: 54420 - RNA, 72 nt, Homo sapiens
agccuuuccaaauacuaaagugcuuaaaaucucauuuauucucugauaaaagaauuugcacuuugggaggcu

SEQ ID NO: 54421 - RNA, 59 nt, Homo sapiens
auaaagccaugagcuugagaugguguacuugaaaggaccguuucaagaucagguuuuau

SEQ ID NO: 54422 - RNA, 66 nt, Homo sapiens
auaaaugucuucuuuugagaagugucuguucauauacuucacccacuuuuugaugaggucguuugu

SEQ ID NO: 54423 - RNA, 60 nt, Homo sapiens
auaacguuuuuguuaauggcacaaaacaguucauuauugcuuuugacagaaacuuguugu

SEQ ID NO: 54424 - RNA, 72 nt, Homo sapiens
auaagaugagcagacuguaucaaugucaguauugugguugugauacuguacugcaguucugcaaaauguuau

SEQ ID NO: 54425 - RNA, 82 nt, Homo sapiens
auaauauuccauugucuagauguaacacaguuuauccauucaccuaaggacaugcuguuugcauccagguuuuggcaauuau

SEQ ID NO: 54426 - RNA, 85 nt, Homo sapiens
auaaucccauagacacugcauauuuuuuuaaguccugaucuucacaguagagcuuaaagaaaguguaguauuguaauguaauuau

SEQ ID NO: 54427 - RNA, 56 nt, Homo sapiens
auaaucccuuuguccagucucuuuucucuggaaaaguugcuaugaaaagggaauau

SEQ ID NO: 54428 - RNA, 55 nt, Homo sapiens
auacagaggggugaaaguucacagguuauucugugaacagucaucucucuuguau

SEQ ID NO: 54429 - RNA, 72 nt, Homo sapiens
auacuauuagguuggugcaagaauuauugcuguuuuuguaucacaguuacuuuugcaccauccuaauaguau

SEQ ID NO: 54430 - RNA, 78 nt, Homo sapiens
auacuuguugagagaaaaaauuuauugguaaaacuaucucaaagcuuaucaaugaaauuauucuuucauuuugggugu

SEQ ID NO: 54431 - RNA, 66 nt, Homo sapiens
auagaugacaguuaggaagcugguggagcuuuaaugcuugcuuugcuuuguugauggugagucugu

SEQ ID NO: 54432 - RNA, 64 nt, Homo sapiens
auagauguagauuuacuuccugugacuuugcagauagaguacaggcaaguuagucaucauuuau

SEQ ID NO: 54433 - RNA, 56 nt, Homo sapiens
auagcagaagaagggacaauucacauucucuuguagggauguccaucuucuccugu

SEQ ID NO: 54434 - RNA, 120 nt, Homo sapiens
auagcagaauugugcuuacaauaagcauguacaguauaguaauaggauuugggugacuaaauuuaccauuuugcugucauugccaaugcuuuugguugugaaaauuuauaaaauugcuau

SEQ ID NO: 54435 - RNA, 65 nt, Homo sapiens
auaggaaguuucuugauuacuuauucaaucuuuuuacuuuuaauaggucuaaggagacuuucugu

SEQ ID NO: 54436 - RNA, 56 nt, Homo sapiens
auaguaaacauaguucuuuugcucuaaaucuagagcaauuguggguauguuucugu

SEQ ID NO: 54437 - RNA, 56 nt, Homo sapiens
auauagacacugaaaucccugccaacccaguuugcaugacaauuucaggucugugu

SEQ ID NO: 54438 - RNA, 57 nt, Homo sapiens
auauagacugcacguaagucacagguuauugguccuggaaaguacuugaguuuguau

SEQ ID NO: 54439 - RNA, 82 nt, Homo sapiens
auauauauauauguacacauacauauauguguguguauauauauauauacacacguaugugugugugugugugugugugugu

SEQ ID NO: 54440 - RNA, 112 nt, Homo sapiens
auauauugcuuuacaaggauuaugugaggauaaaugcaaugguauuuuugacauauuauaguacucaagaaauuguaguuauuucugcauugaauuuuuggauguuuugugu

SEQ ID NO: 54441 - RNA, 110 nt, Homo sapiens
auaucacggggggauguacaccaccugagauauugggaguaaugucaggcucucccuuuccuggauauuacgaacaauaucacagcguggguguacaccuccugcuauau

SEQ ID NO: 54442 - RNA, 61 nt, Homo sapiens
auaucaguauggauucauggauuccucuuguauucaaugaguuauaaucugcuacugauau

SEQ ID NO: 54443 - RNA, 74 nt, Homo sapiens
auaucagugauggcacugccuggcuucauggcacccugccgugcugcaugaagacaggcugugccuucuggugu

SEQ ID NO: 54444 - RNA, 81 nt, Homo sapiens
auaucaguuccuuucauuucaaacauuugcuugacauuuguaguaauuaggugaaugcuggaagaaaugauuaaaugauau

SEQ ID NO: 54445 - RNA, 84 nt, Homo sapiens
auauccuuugcccauuuuuaaugggguuguuuguuuuuguguguguauauaaauucauuuaagcuccuuauagaugauggauau

SEQ ID NO: 54446 - RNA, 63 nt, Homo sapiens
auaucugcauugccauuuaugugggauaaagcuuguuuacccuuaaagguauuguguaggugu

SEQ ID NO: 54447 - RNA, 104 nt, Homo sapiens
auaugaacacagguaugcacaugcaugcuugaauaucugagugcauacaugcuuggauaucuaugaauguaugugcaugaaucaagucucuucugugugcaugu

SEQ ID NO: 54448 - RNA, 62 nt, Homo sapiens
auaugucuggcagaagacuucucaguggaaaccucauaugcugagagaguggcaugacauau

SEQ ID NO: 54449 - RNA, 86 nt, Homo sapiens
auauguucuaauccucuaauguaaccugcaaauauuaccuuacuuggaaaaagagucuuugcagaugcaguaaaguaagaauguau

SEQ ID NO: 54450 - RNA, 76 nt, Homo sapiens
auauugaaggaggugcucacucucggaugcugaugcuacacuugccaacccugagagugagcaucuccuuaaaugu

SEQ ID NO: 54451 - RNA, 77 nt, Homo sapiens
auauuuucagguaaaaaguagaaugaagcauucucagaaacuucuuugagaugugugcauucaacucacagagaugu

SEQ ID NO: 54452 - RNA, 68 nt, Homo sapiens
auauuuugauuuacuuccaugucucauaauauugugccagagucagguuggaaaguaagucaugauau

SEQ ID NO: 54453 - RNA, 81 nt, Homo sapiens
aucaaaugaaagguuuaauucugugagaugaaugcacacauuagaaaguaguuucacagauaaauucuuucuagguuugau

SEQ ID NO: 54454 - RNA, 77 nt, Homo sapiens
aucaccacccuaucagauguccagagauccauuugccuuuuugcggucuuaugaacaguuguauggggaguggugau

SEQ ID NO: 54455 - RNA, 101 nt, Homo sapiens
aguuauuuaaggcaaacagcugaaauugcacaaguggugauuugguuaauucugccaguugaguaaguaauugugacacauuucauaguuugcuuaugauu

SEQ ID NO: 54456 - RNA, 63 nt, Homo sapiens
agugugaacagaaccugggaucgaagucacuccugugauuaggugacuaauucuguucacauu

SEQ ID NO: 54457 - RNA, 128 nt, Homo sapiens
agugugauaaauaagaaaaaacaugggccuguaagacacagugacaugggaucaaaucugauuguggcuacaauuacugguuaauuuccaguuacugcucccaaccccuccauuccauucucuacacu

SEQ ID NO: 54458 - RNA, 75 nt, Homo sapiens
aguucguacccuuaagcacuaguucagcuguucucaaacuuaaauacgcauaauaauagcuuaggggaacugauu

SEQ ID NO: 54459 - RNA, 82 nt, Homo sapiens
aguucuaggguacaugugcacaaugugcagguuuguuacauauguauacaugcgccauguuggugugcugcacccuuuaacu

SEQ ID NO: 54460 - RNA, 67 nt, Homo sapiens
aguugaucucauuggcuacugaggcuuguggauucaucacguaguucucaugccaugguuuucagcu

SEQ ID NO: 54461 - RNA, 60 nt, Homo sapiens
aguuguagcaagacuggauggcugaugaccuagauucuggccccaguuuuucuauuagcu

SEQ ID NO: 54462 - RNA, 82 nt, Homo sapiens
aguuguaggguacaugugcacaacgugcagguuuguuacauauguauacaugcgauauguuggugugcugcacccauuaacu

SEQ ID NO: 54463 - RNA, 82 nt, Homo sapiens
aguuuuagggcacaugugcacaacgugcagguuuguuacauauguaugcauaugccauguuggugugcuguacccauuaacu

SEQ ID NO: 54464 - RNA, 82 nt, Homo sapiens
aguuuuaggguacaugugcacaacgugcaaguuuguuacauauguauacgugugccauguuggugugcugcacccauuaacu

SEQ ID NO: 54465 - RNA, 82 nt, Homo sapiens
aguuuuaggguacaugugcacaacgugcagguuuguuacauauguauacaugcgccauguuggugugcugcacccauuaacu

SEQ ID NO: 54466 - RNA, 61 nt, Homo sapiens
aguuuuugaaugaacauugcuaugugguuauaaacugauggcaauggcauucauuuuaacu

SEQ ID NO: 54467 - RNA, 65 nt, Homo sapiens
aguggcugagauuuauugagcaacuacuauaugcuaaggguuguaugcuuauugucucauccacu

SEQ ID NO: 54468 - RNA, 67 nt, Homo sapiens
aguggggaaauaucaauauuugaucaaauuaacacuaccuccuucccaguguugguguucacucacu

SEQ ID NO: 54469 - RNA, 81 nt, Homo sapiens
aggugugaggugauaucucauugugguuuuaauuugcauuucacagaugauuaaugaugaugaguauuucuucauguaccu

SEQ ID NO: 54470 - RNA, 63 nt, Homo sapiens
agguuacagugaaaagauggcugucugugaaccaggaaacagaccucacuagacacugaaucu

SEQ ID NO: 54471 - RNA, 75 nt, Homo sapiens
agugguacugaggaguagggcacaaagccuugggcauagcugucaaggcuuuagcagcccaccccuuguaccacu

SEQ ID NO: 54472 - RNA, 109 nt, Homo sapiens
aggucugggucuuuuccuguggagaguuaagcuuuuagguccuccucaccugaggccccgggcugacggaggcauuggaagcuuguaaaagucagggcugagaugaccu

SEQ ID NO: 54473 - RNA, 91 nt, Homo sapiens
agugaaugcaguggaggauaagggaagcagcuuuuauugaucuuguuauuuauaugaaaacaugauuugccuguuuaccacaguguucauu

SEQ ID NO: 54474 - RNA, 101 nt, Homo sapiens
agugagagguauggcagaagaggugaggagucagacugugcaaggucuuagaggacuuuuagggauuuuggucauuugccuaucugcaaugggaaguuacu

SEQ ID NO: 54475 - RNA, 56 nt, Homo sapiens
agugcauuugcaucucaauauaaagucacugcaugauauaccaaugcggaugcacu

SEQ ID NO: 54476 - RNA, 84 nt, Homo sapiens
agugccugauacacgguaggcacauauuuauuuguucagccauuuaacaaacauuuagggagcaccugcugugugccaggcacu

SEQ ID NO: 54477 - RNA, 128 nt, Homo sapiens
agugcucuauuuuuuaaaaccuguacugacucauuuaauuaucauggcaagccuaugaaauagcuacuauuauuaucacaguuuugcauauggguaaaugaaggcacaaaagggaaaaauagcuugcu

SEQ ID NO: 54478 - RNA, 73 nt, Homo sapiens
agguacuuagugaauguuggcuauuaauacuauuacuauauaugcaguguuacuaauaauucauucaguacuu

SEQ ID NO: 54479 - RNA, 55 nt, Homo sapiens
agguauuuagucuuguguccuauccuuucuuuuuaggauaguagauuaaauauuu

SEQ ID NO: 54480 - RNA, 103 nt, Homo sapiens
aggucagcuggucuucagcuugacccuagaauugacucuaggagcagugacccugcugccucccagagccaguuauaggcucaagaucaagaccaacugaccu

SEQ ID NO: 54481 - RNA, 66 nt, Homo sapiens
agggcuugcacuugaaauuccaguuuguagcuccacagugaaagcuauggguuucaagugggcccu

SEQ ID NO: 54482 - RNA, 85 nt, Homo sapiens
agggugguuuugccaaacaaaggugcaguuggaugaaaaaccaguguaaauauuugcacauuuuuucuggcagaaauccuacucu

SEQ ID NO: 54483 - RNA, 77 nt, Homo sapiens
aggguucaauaaauaguaguugugguggccauucuuacuagguuugguugcaggcaagugcuauucugcuggucccu

SEQ ID NO: 54484 - RNA, 62 nt, Homo sapiens
aggguuccuaacuuucuauaguuaugaacuuuuuugguuaucuaaggaaagcuaugaacccu

SEQ ID NO: 54485 - RNA, 79 nt, Homo sapiens
agguuggagugcaauggugaguucucagcuuauugcaaccuuccccucccagguucaagcaauucuccugccucagccu

SEQ ID NO: 54486 - RNA, 86 nt, Homo sapiens
aguaauaggaccaaaugaucacauuuauaguggcacgcauaguaguuuaugaguggcaguauaugugugaguguuuccuuugugcu

SEQ ID NO: 54487 - RNA, 84 nt, Homo sapiens
aguacauuguaauuugaucacauuguuucauacauauucugggacauccuaaaauuguacaugcagugagucaucuuacgugcu

SEQ ID NO: 54488 - RNA, 82 nt, Homo sapiens
aguagaagaugaauacaaagcuuucugcaaaucauuuucaaaggaaagugaugacccuguggcuuguauucacuuuacugcu

SEQ ID NO: 54489 - RNA, 55 nt, Homo sapiens
aguagagguaggucuucgagucucagggacaucccuggccugcccaaugucugcu

SEQ ID NO: 54490 - RNA, 129 nt, Homo sapiens
aguagccaucucaguuaucagacuguuguggcauaaaagcgcuuguguucuuguauccuuuauuuuacuuaauaauggcaccaaagcacaagagcaguuaugcuggaauacuguuauaauuguucuauu

SEQ ID NO: 54491 - RNA, 90 nt, Homo sapiens
aguagcuauauauaaacacauacacacauguguauaugugugugcacgcauguaugcacauauguguauguauuuguguguauaucuauu

SEQ ID NO: 54492 - RNA, 65 nt, Homo sapiens
aguaggcuuagcugucaagggcauucccaucaacaaagcccuguugacagaaaauugaguuugcu

SEQ ID NO: 54493 - RNA, 80 nt, Homo sapiens
aguauaaauaaaggugcuguaagcauccauguggagggcuuuauguggacauauguuuucagcuccuuuagguaaauacu

SEQ ID NO: 54494 - RNA, 61 nt, Homo sapiens
agucaaaaaagaagcuauuauuaaauggaauaacauaguaauaaagcagcuuuuugggacu

SEQ ID NO: 54495 - RNA, 94 nt, Homo sapiens
agucaaacuugagguuuauggaggagguaggaauugugcuaggacugaagcauuuggaccugggcucaaguccugccuccuucucauaauggcu

SEQ ID NO: 54496 - RNA, 80 nt, Homo sapiens
agucacagauuaaugugucaaauuaauguauuuguguugguuaauauaaaugcuucuauguggcauguuuagucaagacu

SEQ ID NO: 54497 - RNA, 72 nt, Homo sapiens
agucauuaagaguacaaaauguagauucagacuaccuggguucaaaucuuggcucuuacuugcauuguggcu

SEQ ID NO: 54498 - RNA, 57 nt, Homo sapiens
agucauuauguuuugggcgauuuguuaugcagcaauagagaacugaaacaugugacu

SEQ ID NO: 54499 - RNA, 60 nt, Homo sapiens
agucuccaccucuggggcucaagcgauucucccaccucauccucccuaguagcugggacu

SEQ ID NO: 54500 - RNA, 130 nt, Homo sapiens
agucuccaugacugugagccaauuaauuucuguuuauauuaguccauucucaugcugcuaugaagaaauucuugagacugguuaauugauaaagaaaacagguuuaauugacucacaguuccauaugacu

SEQ ID NO: 54501 - RNA, 112 nt, Homo sapiens
agucucgcucuuugcccaggcuggagugcaauggcuugaucucggcucacugcaacccucugcuuccuggguucaagcaauucuccucucagccucccaaguagcugggacu

SEQ ID NO: 54502 - RNA, 58 nt, Homo sapiens
agucuuagcucuguuuccucagcauuccuagcuaugcagugugcaacagauuaagacu

SEQ ID NO: 54503 - RNA, 67 nt, Homo sapiens
agucuuugccuguuaacauagcauauuaugguaauauggugguauguaugauuaacauggauugacu

SEQ ID NO: 54504 - RNA, 60 nt, Homo sapiens
agucuuuucccauuguucugcucuguggaagucaccuucagaguaauagugggggugacu

SEQ ID NO: 54505 - RNA, 71 nt, Homo sapiens
aggcccuugcucaaaacagaaaauugucaucuuauaugucuuauuacauuuuccuguagggggcaaggccu

SEQ ID NO: 54506 - RNA, 76 nt, Homo sapiens
aggcgaagcuaugaagccagccauaugccauguuauaauuaugaugccguaaaucucuguuuucauggaccugccu

SEQ ID NO: 54507 - RNA, 130 nt, Homo sapiens
aggaucaucuucacuagcugucucagcauugccuuggaggucauugaugugcaacugcuggaacagucauaaacauggcugugcauacaaugccccauuugucaugcucaguuuaucugaaggugguccu

SEQ ID NO: 54508 - RNA, 88 nt, Homo sapiens
aggcacuugcuggcuggcugagugguaaguagaggagugaauggcuccucacacccguccccgccagcccagcccucaguaucugccu

SEQ ID NO: 54509 - RNA, 56 nt, Homo sapiens
aggcagagguugcagugaguggagaucaaucgcgucaugucacugcacucuagccu

SEQ ID NO: 54510 - RNA, 89 nt, Homo sapiens
aggcagucacaggauaauaaagcugaauccuuccugaaugucucuaaaauguucaugguucuuucuagcuuuaugguuggucacugccu

SEQ ID NO: 54511 - RNA, 56 nt, Homo sapiens
aggccaaauagcagguuugcuaaauguuuuaauguuguaaacugcuuccuuggccu

SEQ ID NO: 54512 - RNA, 69 nt, Homo sapiens
aggcuaccuugugagguugauaugaagauuaaauuaauuaauucacauaaagcacuuagaacaaagccu

SEQ ID NO: 54513 - RNA, 79 nt, Homo sapiens
aggcuagagugcagcggcgugaucuugacucacuggaaccuccgccucccagguucaagcaauucugcugccucagccu

SEQ ID NO: 54514 - RNA, 79 nt, Homo sapiens
aggcugaaaugcaguggugugaucuuggcccacuccaaccuccaccucccggguucaagugauucuacugccucagccu

SEQ ID NO: 54515 - RNA, 79 nt, Homo sapiens
aggcugaagugcaguggcaagaucuuggcucacugaaaccgccaucucccagguucaagcaauucuucugccucagccu

SEQ ID NO: 54516 - RNA, 106 nt, Homo sapiens
aggcugaggcagaagaaucgcuugaacccggugggcggagcuugcagugagcugagauagcgccacugcacuccagccuggguggagcgccacugcacucuagccu

SEQ ID NO: 54517 - RNA, 73 nt, Homo sapiens
aggcuggagugcaguggugcgaucuuggcucacugcaaguucugccuccuggguucgcgccauucuccugccu

SEQ ID NO: 54518 - RNA, 79 nt, Homo sapiens
aggcuggagugcaguggugugaucucggcucacugaaagcucugccucccggguucgcgccauucuccugccucagccu

SEQ ID NO: 54519 - RNA, 56 nt, Homo sapiens
aggcuguagugcaugugcuaugaucaugccugugaauaaucauugcacucuagccu

SEQ ID NO: 54520 - RNA, 82 nt, Homo sapiens
agggacuuuauucauucuuucacagaagagaaaaagagaaaaauaugucuauuccauuugugaaaggaaguguaacuucccu

SEQ ID NO: 54521 - RNA, 102 nt, Homo sapiens
agggagcucuggcuuagauucuguauuauuuuguguuauacugauuuuuagaaaauggaauguagcguugacacgagcacaaaucucagcaagggccuaccu

SEQ ID NO: 54522 - RNA, 68 nt, Homo sapiens
agggagugagucagucugcuguugcuuacucucggugcuggcugagcucagcaaccugcucucuuccu

SEQ ID NO: 54523 - RNA, 98 nt, Homo sapiens
agggauguaugguauuuauggcuggguaggaccagaaaugcacuuuguauuacagaguguuaaggcugguugcuauaguauggaacagaaacaccucu

SEQ ID NO: 54524 - RNA, 63 nt, Homo sapiens
agggccaugucucugaguaggcaaggagaauagaaucuauugcacaugaggagacauuguccu

SEQ ID NO: 54525 - RNA, 88 nt, Homo sapiens
aaucugagauugucaugauuacauuguuuugggguuaaaguguccaaucaucucccaccauaaaaugauggugacaauaauucagguu

SEQ ID NO: 54526 - RNA, 76 nt, Homo sapiens
aaugagauaaucuggguaaugcauuuagcauauggcuggcaugaaguuaagugcucaguuacucaguuauuauauu

SEQ ID NO: 54527 - RNA, 78 nt, Homo sapiens
aaugauugcuagggagaauuauuggauacaggaacagagauuaucuuguaauuuaaaugauccuuggaguuagucauu

SEQ ID NO: 54528 - RNA, 94 nt, Homo sapiens
aauaucacagaguguacacccacugugauauuaggagaaagcucucccuuggguauuagaauaauaucacaggguguacacucacugugauauu

SEQ ID NO: 54529 - RNA, 102 nt, Homo sapiens
aauauccacuguaagcucugucugaacugagacuagacuuguuccuucauggguggaggaacaaguuuagacucaguugagacauagcuuacaguggauauu

SEQ ID NO: 54530 - RNA, 87 nt, Homo sapiens
aaggugguaguacuacaguagagaggauguagaaauagggcagaaguuguuaagucuugcucugcuguugacuacccaugugaccuu

SEQ ID NO: 54531 - RNA, 75 nt, Homo sapiens
aaucaggacauguuccuuuucaucuuugccucccauaauuuucuuugguagaggucuuaucaaacaugcuugauu

SEQ ID NO: 54532 - RNA, 64 nt, Homo sapiens
aaugccucagugguuucuuuaaaagcauacaguaugcugccuacaagagacucauuguagcauu

SEQ ID NO: 54533 - RNA, 70 nt, Homo sapiens
aaugcuguucauugaugacacugauuucuucaauguucauacauguugaagugugugucagaacuuuauu

SEQ ID NO: 54534 - RNA, 65 nt, Homo sapiens
aauggaaauugauggcuaauaugaaaagaugaaagucugaguucaugaggccauucaaauccauu

SEQ ID NO: 54535 - RNA, 84 nt, Homo sapiens
aauguacacagucaaaaauuuccaggcacaucugcucucuccucuccuauuugacauugcacuggagauucuggcaaguauauu

SEQ ID NO: 54536 - RNA, 63 nt, Homo sapiens
acaaguguuucaguggguacaugcuuccguuucuuguggguaaauacccagaagcagcauugu

SEQ ID NO: 54537 - RNA, 108 nt, Homo sapiens
aauuggauuuagaagucuauggaaauuauuaggaagauggguuuuaagugaccaguuuuuuauacaucuucuuugacagugauuugugcauaagcuucugaaguaguu

SEQ ID NO: 54538 - RNA, 89 nt, Homo sapiens
acaauaaugaauauugcuggaaagugaaugugcuggaauagcuucagagagcuuaucuccauauauuuucuuaauuggcacauuauugu

SEQ ID NO: 54539 - RNA, 68 nt, Homo sapiens
acaaugaaggaaaagggccuagaauuuuauuuugaguacaguaaugggccccuuuuccuauugguugu

SEQ ID NO: 54540 - RNA, 108 nt, Homo sapiens
aauguuuucuuuaggcauagauuggugcauguauuuuaaacagaguuguauuuuauauacuguuuauaaccuguaaccauaugaucaguuuccaugucuuuaaauauu

SEQ ID NO: 54541 - RNA, 118 nt, Homo sapiens
aauucccuauccaucuuccuacacacuuucauagccuuugucgucugagggaaaaagaaagguuuucaucaugccaguuaaaggcugugaaugugaccuagauaauucuuggggaauu

SEQ ID NO: 54542 - RNA, 68 nt, Homo sapiens
aauucuaugagguugguauuacugucucuauuuuaagaucaggggcuuuaagaaacuucccuaggauu

SEQ ID NO: 54543 - RNA, 84 nt, Homo sapiens
aauuuaugagguuccuaaucuccauauguucaguuaugcagugaaauaugauuuguuugcauugcauagacauccucauagauu

SEQ ID NO: 54544 - RNA, 93 nt, Homo sapiens
aauuugaaauauuaacugggcauggugguacacaucuguagucucagcuacucaggaggcugagaugugaagaucacaugaacccagcagauu

SEQ ID NO: 54545 - RNA, 93 nt, Homo sapiens
aauuugauagucuuugauagcaauaugacauugcuacauccaagugugggagucaguacacuuauauugcgcauaucuuggacauuuuagguu

SEQ ID NO: 54546 - RNA, 68 nt, Homo sapiens
aauuugccuggggucaacuuuuaauugcuggagugagcagcacuucacauuguacaaacagguaaguu

SEQ ID NO: 54547 - RNA, 125 nt, Homo sapiens
aauuuuagacuuguaucucuuuguaaggacccuuggaaauuaacagggauuguccauacucugagaggaaguggcuucucugucuaguuucuaccacuuauaauuauguuggucuuuuuaaaauu

SEQ ID NO: 54548 - RNA, 99 nt, Homo sapiens
acaaacgguuccuggccuuguaaauaccaguuucuggaacagaguuucugaauuucugucuuagaaauuauguauuuaauaaaugugagaauaauuugu

SEQ ID NO: 54549 - RNA, 64 nt, Homo sapiens
acaggaagaaagugcaguagauucucauuauucacaaguucuaaauuugcaaauucuucccugu

SEQ ID NO: 54550 - RNA, 56 nt, Homo sapiens
acaguauggugguagugacauucaacuauccacauauaucacaaccacagugcugu

SEQ ID NO: 54551 - RNA, 111 nt, Homo sapiens
acagucuugauccuauggguucugaaaaguucuuugagccuugacaagcagacguauugguguuaagaagcccagggaauuggcagaggccugaagaugcacagaggcugu

SEQ ID NO: 54552 - RNA, 68 nt, Homo sapiens
acauagcagguguuccacaaauauugguuaccuuacugauaaccaauguaguugaauauuugcuaugu

SEQ ID NO: 54553 - RNA, 71 nt, Homo sapiens
acauauguuacaaacccauauuauauuguuauuauuuuaguguaaaaaguugauaugguuuggauaugugu

SEQ ID NO: 54554 - RNA, 77 nt, Homo sapiens
acacccuuccauggaguugucuacuauguccaaggaacuagacuggaaaauggaagacuccucuuuggguauggugu

SEQ ID NO: 54555 - RNA, 92 nt, Homo sapiens
acacuauuaaauauuuggaaaauuagcaagaugaauuugugcaaacaguuauauauaguucuguuuguucuuauuuuuuauauauguggugu

SEQ ID NO: 54556 - RNA, 63 nt, Homo sapiens
acacucacauacauacaauguccaauaugggguuucuucuuacaaaguauggaauguuggugu

SEQ ID NO: 54557 - RNA, 78 nt, Homo sapiens
acacuuuggaaauguguuugcauucagugagucuuuugcacuacauuggagaaacugcaaacauacuuucuguugugu

SEQ ID NO: 54558 - RNA, 69 nt, Homo sapiens
acagaaguuugacauguuuagcucuuccaaauauagaguuaaucuagcagcuaaauuggaaauuucugu

SEQ ID NO: 54559 - RNA, 129 nt, Homo sapiens
acagagaacagugagcggagagaaaaagucuccuuaacccagaguuccuugucuuucaccaguggggacuuccaugacuuggcuagacugaggggucuggggugugacuuggcuguuucugcucucugu

SEQ ID NO: 54560 - RNA, 126 nt, Homo sapiens
acagccaguccccaggccugugaagggaggugagcagcacauggcagaacauauugaagaccaaggagucaguggcccucugugugcugcauacggacugccggaggaaggcuugcuggaggcugu

SEQ ID NO: 54561 - RNA, 130 nt, Homo sapiens
acagcuaauaucacaguaaauguacaccauguguguacacccugugauauuaauaauauccuagggaaauauuacuccuaauagcacaguguguguacaccauguguguacagccugugauauuauuugu

SEQ ID NO: 54562 - RNA, 64 nt, Homo sapiens
acaucucaguucaggcuggccacauuucuucaaguugaaauguggcuaacccaaauugagaugu

SEQ ID NO: 54563 - RNA, 60 nt, Homo sapiens
acaucuguacagugggugugguagcucccaugaucuucaggggccacaccacucagaugu

SEQ ID NO: 54564 - RNA, 79 nt, Homo sapiens
acaucuuuuugcaauuugugaauauugugauccagccauguucacaggccauuugggauaaucacaaaguaaaacaugu

SEQ ID NO: 54565 - RNA, 98 nt, Homo sapiens
acaugagacuaggguuguuuggccuguaggguauugguaggggcugcuguggucccuuugcucacccuugggccagcugacuccuucauucucuaugu

SEQ ID NO: 54566 - RNA, 85 nt, Homo sapiens
acauuacugcacgugucuuuuggugaacaaauguagcauuuuuguugaauauguuucuaaaagugcaauugcuaauucaugaugu

SEQ ID NO: 54567 - RNA, 82 nt, Homo sapiens
acauuccuggagguauaauuauaggaucauugacuauuauaaggcugcuaaagcaugaugcuaaauuucuuuucaggagugu

SEQ ID NO: 54568 - RNA, 58 nt, Homo sapiens
acauucugagaaaugugucauuaggugauuuuguccuugugugaacaucacagagugu

SEQ ID NO: 54569 - RNA, 79 nt, Homo sapiens
acauuuuagcaccaaacauauacucagucagcaccagagacugcucacuagagaagaguguuaugugugcugugaaugu

SEQ ID NO: 54570 - RNA, 103 nt, Homo sapiens
accaauaaauugagggcuaggaaagcuguguugugcccagcaucauagacagcacugucuauguguggaauuauaacaggcccaagaucucuaagugauuggu

SEQ ID NO: 54571 - RNA, 74 nt, Homo sapiens
accaauagcugucaguuuuaacuagggaauaucagucuauugauguuuauagauggcugaaggcaguauauggu

SEQ ID NO: 54572 - RNA, 58 nt, Homo sapiens
accaaugucuuugacugaugaacccacaaacaggcauucaucagucaaagacaauggu

SEQ ID NO: 54573 - RNA, 130 nt, Homo sapiens
accacauuuucuuuauccagucuagcauugaugggcauuuagguugauuccaugucuuugcuauugugaauagugcuggaauuaacauagaugugcauguguugauagaacaauuuauauuccuuugggu

SEQ ID NO: 54574 - RNA, 55 nt, Homo sapiens
accacccauucucugaccguggggucuguggcccacacugucuucaauggguggu

SEQ ID NO: 54575 - RNA, 66 nt, Homo sapiens
accacgccuggcuaauuuuuugaaucuuuaguagagacaggcuuucaccguguuggccaggcuggu

SEQ ID NO: 54576 - RNA, 94 nt, Homo sapiens
accccaugacauugauuagcacaucuucuuggccugcaacucauucauaugugcauauuuugucggcccaaugagaguguuagcagaaaggggu

SEQ ID NO: 54577 - RNA, 70 nt, Homo sapiens
accauagguuuucacuguagauucuguggacccccagccuauggauucugucagauggcaaaucuauggu

SEQ ID NO: 54578 - RNA, 88 nt, Homo sapiens
accauaugucacuuuacacuguacuuuaucgugugaguuuuguguuuucacacugaauuugaagcaauguaaggccgacaccuauggu

SEQ ID NO: 54579 - RNA, 122 nt, Homo sapiens
accaucauguaacuaccaaaucaggaaauacaggguuaguauugguaauuguaauggcaaaauauuuauuuacaagcacaaauuuaauccugucacuuuccugauuuaauuuugcuaauggu

SEQ ID NO: 54580 - RNA, 92 nt, Homo sapiens
accauggacuauaacagcugcaaggcaaaagcagcaaauaaucaauggagaaaugccuggcuuuugccuuuggucuuuaucuaggucugggu

SEQ ID NO: 54581 - RNA, 61 nt, Homo sapiens
accauugcaguuuuugguguaucucaucaauuugcugagcauacuucucagacguaauggu

SEQ ID NO: 54582 - RNA, 58 nt, Homo sapiens
acccaggaggcagagguugcagugagcagagauugugccacugcacuccuccuugggu

SEQ ID NO: 54583 - RNA, 61 nt, Homo sapiens
acccaggaggcagagguugcagugagccaagaucacgccacugcacuccagccuccugggu

SEQ ID NO: 54584 - RNA, 90 nt, Homo sapiens
accccacaguccccacccuugcagggacagcuuugucaugcggguagcauaguacauguuugaaggugcccaugaagguuggggaggggu

SEQ ID NO: 54585 - RNA, 60 nt, Homo sapiens
accuaaaaggcuaguuuccaacuagcuccugaaggcuaacuggaaauuaaccuuucaggu

SEQ ID NO: 54586 - RNA, 111 nt, Homo sapiens
accuaggacuuugggacaauaaaagauaaagaugaguuuuagcaaauuuugcugaaucuugcacaauggaauuuaucuuugugaacucuuuuaaaaauucaacuucuaggu

SEQ ID NO: 54587 - RNA, 62 nt, Homo sapiens
accuccucugggccugguguuuguggcaucuguggcaguuugaauaacagccccagggaggu

SEQ ID NO: 54588 - RNA, 56 nt, Homo sapiens
accucugccuaguuuucagaggauguauggaaauaccuggaugucgaggcagaggu

SEQ ID NO: 54589 - RNA, 67 nt, Homo sapiens
accugagguuggguaauuuaugaagagaaaagauuuauuuggcucauaauuacgcuagcugaaaggu

SEQ ID NO: 54590 - RNA, 56 nt, Homo sapiens
acguguaacuucaaaugggaagaucccuuguccuuccugagaauagaguugcaugu

SEQ ID NO: 54591 - RNA, 70 nt, Homo sapiens
acuaauggauuaacgucccugucgugugacauuuucugguaugacagcugaagauguugaaccguauggu

SEQ ID NO: 54592 - RNA, 83 nt, Homo sapiens
acuacauuuaucagacugaugcagcuaggauuugugacaugauuuagauuucaucgaugagcugcauuuucaugaaauguagu

SEQ ID NO: 54593 - RNA, 129 nt, Homo sapiens
accuuggagcucacagcauugucuugguugggggaccaugugggcggcagguccuggcugugcucgcuccccacccugucauccacauggugcucugucgggggccuggggcaugcugcccuccagggu

SEQ ID NO: 54594 - RNA, 84 nt, Homo sapiens
accuuugaauuauucugauuuuugcauggcuuucaagcugaaccuuguaaaugaauaguuugacagaacucuuuaaugaagggu

SEQ ID NO: 54595 - RNA, 61 nt, Homo sapiens
accuucaagaggcauuuuccaaauacuucacuuacucuguuuacaauggcuccuugaaggu

SEQ ID NO: 54596 - RNA, 77 nt, Homo sapiens
accuucuuugaagcagaaagauggugaauaugguaauuuuuauggcuuacuaccagcauuucucuuuaaguaaaggu

SEQ ID NO: 54597 - RNA, 78 nt, Homo sapiens
aaaccauacuguguccuuuauacuguccaaaauuucauucuuccuuauuuucaguguggcaggcauagcuaguuguuu

SEQ ID NO: 54598 - RNA, 122 nt, Homo sapiens
aaaagauguuaaugaauuuuuaguaaucauacaauaggaucucaguuuugccuuguuuaagggagagcaucucuuaaccaguuuagaauuguguuagaaucugaaaauuuugcauuucuuuu

SEQ ID NO: 54599 - RNA, 60 nt, Homo sapiens
aaaaggguaacuaugugagaugauagauauguccauuuauugcacuaugguaacccuuuu

SEQ ID NO: 54600 - RNA, 112 nt, Homo sapiens
aaaaucauaaaaaauaacacucuacugucagucuuuuuuuggcaagcauuaaggguaaguggucuuggggauguauugucaggugaagaauggcauaauuuauuaugauuuu

SEQ ID NO: 54601 - RNA, 65 nt, Homo sapiens
aaaauguuagcacuaagaauauauuuuuauauuuuaacuuaggagcuuucuuguguugauauuuu

SEQ ID NO: 54602 - RNA, 98 nt, Homo sapiens
aaacaaaaauggcauuugaauggaaguuuugugaaaucuguugauucaaagauguuaaucauuuuuaccaugacuuguuuauuuauagccuuuuguuu

SEQ ID NO: 54603 - RNA, 66 nt, Homo sapiens
aaaggcaguguggguagagggcaagaaagucugaucgucuugucuguaaucccaauacuacccuuu

SEQ ID NO: 54604 - RNA, 73 nt, Homo sapiens
aaaggcauugcuuguuuaaagcaguuuaaaugauaguaucuuuuaaggcuuuaaguaaacacagcuggccuuu

SEQ ID NO: 54605 - RNA, 77 nt, Homo sapiens
aaaggcuacuauacugaagcaaauuaacauguuuguaaucucacauaguuacugcuauaguuuggauauuugccuuu

SEQ ID NO: 54606 - RNA, 68 nt, Homo sapiens
aaagggugugcagcuaucucauuguuguuuuaauuuacaauuuccuaaugauauguugagcacccuuu

SEQ ID NO: 54607 - RNA, 57 nt, Homo sapiens
aaagguaguacuucuagaagggaggcgaucagaguccaauuaggagauauuacuuuu

SEQ ID NO: 54608 - RNA, 130 nt, Homo sapiens
aaagguuccuuuuccaauuguggggguuagugagacaaaguguaugaaaagcauaaacgcugaagugccauguugguauugcuuagcaacacuuuguucacacugucacguauugcacugcauuuccuuu

SEQ ID NO: 54609 - RNA, 64 nt, Homo sapiens
aaaguaaauagcagaacagugucucacugcaugugugugaugcacaguugcugguagauacuuu

SEQ ID NO: 54610 - RNA, 59 nt, Homo sapiens
aaagugcugagaguucuaacuucauuggcuacguaguggcaaaagcucuacagcauuuu

SEQ ID NO: 54611 - RNA, 55 nt, Homo sapiens
aaagugcugagucuaggcggggcgcgguggcucacgccuguaaucccagcacuuu

SEQ ID NO: 54612 - RNA, 57 nt, Homo sapiens
aaaguggugugaguauguaucuaagucaccugacauugugauucacggcaccgcuuu

SEQ ID NO: 54613 - RNA, 103 nt, Homo sapiens
aaagugguuagugcaacugagaagcugaauuuuuauuguauuuagauuuauauuuaaaugcucacauaaagguagcagcuacaguauuggacggugcagcuuu

SEQ ID NO: 54614 - RNA, 81 nt, Homo sapiens
aaaaaagguuuuaaugcuuggucaagagcagaaaucugauuuuuagcucuuuguuuugacuaggaaauuagaacuuuuuuu

SEQ ID NO: 54615 - RNA, 75 nt, Homo sapiens
aaaaaucugguuuuugcuuggccauugcaauuaagugauuuucugcuuuugcagugucaauaauaauuaguuuuu

SEQ ID NO: 54616 - RNA, 71 nt, Homo sapiens
aaaacuagugaaaucugaagaaggucaugccugaguuaacaguaucaugcugaugucaauuuccugguuuu

SEQ ID NO: 54617 - RNA, 106 nt, Homo sapiens
aaaacucacccacgaccuucaguuacaaucaggagagcagugagcacaacugguuccacaggcaccucacaugcucaccugguguuccugggguucacagaguuuu

SEQ ID NO: 54618 - RNA, 68 nt, Homo sapiens
aaaagaacuugauauucugagaagcugaagaacaauuuguuuuccucagcuagguauuuaggacuuuu

SEQ ID NO: 54619 - RNA, 71 nt, Homo sapiens
aaauauguauuaugcacacacguguuuaugugugcauauauacauguacagguguguguauauauauauuu

SEQ ID NO: 54620 - RNA, 96 nt, Homo sapiens
aacaccaguuaguucuuuuacaucuuaagauugccuuaauuagauaaugguauuuuaguuauggaguaauuuuaagcaguuuuaaauagcuguguu

SEQ ID NO: 54621 - RNA, 64 nt, Homo sapiens
aacagaaagaggaugcagaucucauuuuuauuuggaggaugcagaucacauuuuucugucuguu

SEQ ID NO: 54622 - RNA, 88 nt, Homo sapiens
aacagaacuugaaauuccaggaugcucacggucuacaguguaaaaugcugcacuuuaaggcauccccugagagcgauuucuuucuguu

SEQ ID NO: 54623 - RNA, 67 nt, Homo sapiens
aacagucauggguugccauggugauuauuccaaaugcauugugaucauauggaacuggugacguguu

SEQ ID NO: 54624 - RNA, 58 nt, Homo sapiens
aacagugcuuucaauguucaguauccuuuacaucugcugcucagcuggaaacacuguu

SEQ ID NO: 54625 - RNA, 71 nt, Homo sapiens
aacaugagauacuugguuucuguuucugcauugguuugcuuaggagaguggauuccagcuguauccauguu

SEQ ID NO: 54626 - RNA, 82 nt, Homo sapiens
aacccacuagagagcucugaaguuauagaaccacagcagcaguguguuucuauggucacagaugcuugauuauuagaggguu

SEQ ID NO: 54627 - RNA, 79 nt, Homo sapiens
aacccaugagauauuuagaaauguguucuuuaauucacaaauauuuaaggauuuucucgauaucuuagugucauugguu

SEQ ID NO: 54628 - RNA, 128 nt, Homo sapiens
aaccuccaugcuggauauaagcaaagaggagaggaaagaccuaugcaggaagaaaugaguucuucccuauguguuccuuccugcauagguauuuccccuccuuucuacucauauuuagcaugcagguu

SEQ ID NO: 54629 - RNA, 129 nt, Homo sapiens
aaacugcaacuuuaagcaaaccaacuauagcagguccucaaaugacaucauuucauucaacaucauuuuuuuacagcguugaugagaaaaugugguuuggcuguauguuguuuugccuaaaguuaguuu

SEQ ID NO: 54630 - RNA, 65 nt, Homo sapiens
aaagaucaucauagagggcaugagaaccaaauuauaauggacaucauaugaucagugaugacuuu

SEQ ID NO: 54631 - RNA, 84 nt, Homo sapiens
aaagccuuucuggccgguauuugccucugggggcugcaucaucgucuacccagaguucuuaaauacugagcaacuuaagguuuu

SEQ ID NO: 54632 - RNA, 90 nt, Homo sapiens
aaaucaggaaauacaggguuaguauugguaauuguaauggcaaaauauuuauuuacaagcacaaauuuaauccugucacuuuccugauuu

SEQ ID NO: 54633 - RNA, 67 nt, Homo sapiens
aaaucagugcuuuaucaaguccuccaggugauucugauucauggugaaguuugaaaagcacugauuu

SEQ ID NO: 54634 - RNA, 106 nt, Homo sapiens
aaaucuguuuuccuucccguuagucuaguucugcccauuggcauuaccuggaucaagucgaaugaccaaugggcagagcuagacugaugggaaggaaaacagauuu

SEQ ID NO: 54635 - RNA, 100 nt, Homo sapiens
aaauguauuugauugguuagaauggaaaugcgagguuaguugguggcuucugauuggcuaagccucuacauucauuuuacuguuuauguugguaccauuu

SEQ ID NO: 54636 - RNA, 76 nt, Homo sapiens
aaaugucacagacuccauugaagguaauagguuuagaucaccauuacacuuucuauucaaugagcugaggcuguuu

SEQ ID NO: 54637 - RNA, 92 nt, Homo sapiens
aaaugucuggaaaaccuauuugagauuuuccucaaauauuuccuauuugagggaauaacugaagaaaaauucacuagugcugccagagauuu

SEQ ID NO: 54638 - RNA, 130 nt, Homo sapiens
aaauuacccagucucagguaguaucuuuacagcagugugaagauggacuaauauaguaaguacuuauuuaaaugguguauuagucuguuuucauacugcugauagagacauaccccagacugggcaauuu

SEQ ID NO: 54639 - RNA, 80 nt, Homo sapiens
aaauuacugucagacacuguggccuuuggaccagcuagaagcuugucacgaaaggugacaguguauguugguggaaauuu

SEQ ID NO: 54640 - RNA, 129 nt, Homo sapiens
aaauuaucccuuccuuaaauguucgguagaauuuauuaguaaugcuaucugggccagggguuuuguuuguggaacuuuuuuuuagugguauuaauuauacuucuuuauacauauaaggauaucuaguuu

SEQ ID NO: 54641 - RNA, 61 nt, Homo sapiens
aaauucagggacucauaggcagaagggacuguggccuuaucugagaugagacuuugaauuu

SEQ ID NO: 54642 - RNA, 87 nt, Homo sapiens
aaauuuaaggaggcaccuacucccagggucaugcaaaagccaacuuugcauuugcacaauccugugagugagucccuccuuaaauuu

SEQ ID NO: 54643 - RNA, 87 nt, Homo sapiens
aaauuuuugcauagaccgaugucuuggagcauuuucccuaagcuuuguucuaguaguuuuauagaugugggucuuauguuuaaauuu

SEQ ID NO: 54644 - RNA, 95 nt, Homo sapiens
aaauuuuuguagaucuuucuuauuugauugacuuuagcaggaccauuuagguuccuuuauuagugcaagucaaaucuagaggcauuuaagaauuu

SEQ ID NO: 54645 - RNA, 129 nt, Homo sapiens
aacuccugaccucagguaauccacccgccucagccucugaaagugcugggauuggccgggccaguggcucaugccuguaaucccagcacuuugggaggcugaggugggcggaucacgaggucaggaguu

SEQ ID NO: 54646 - RNA, 87 nt, Homo sapiens
aacuccuuuguagucacagugaccuugucugacuuugcaaauucuggggucauuuuaugaucacuguggauugacuacaggugaguu

SEQ ID NO: 54647 - RNA, 65 nt, Homo sapiens
aacucuauacuuuugggugucgcugcuauaaucuaguucuccuuauugcagauacccaggaaguu

SEQ ID NO: 54648 - RNA, 82 nt, Homo sapiens
aacucuuucucauuuaucuggggagaggguagaggucaggaugacauuuaagucacuccagguuaaagugaaggacugaguu

SEQ ID NO: 54649 - RNA, 73 nt, Homo sapiens
aagccugaguccuuuggccauagcuaaaugauuucauucuuuucaaaucaucuagguugagccaaucaggcuu

SEQ ID NO: 54650 - RNA, 88 nt, Homo sapiens
aagcucccuaggugguuuugaugagcagguaggcuuaagaacuguuaccuuaucucaagaccauuuuuuuuccugaacagcggagcuu

SEQ ID NO: 54651 - RNA, 55 nt, Homo sapiens
aagcuggagugcaguggugcaaucuuggcucacugcaaccucugccuccuggcuu

SEQ ID NO: 54652 - RNA, 55 nt, Homo sapiens
aagcuggagugcaguggugcgaucuugguucacugcaaucucugccucccaguuu

SEQ ID NO: 54653 - RNA, 64 nt, Homo sapiens
aacugcuguuuggguacugguggguugcaacuauuaaaucuccccagacaagccacuuagaguu

SEQ ID NO: 54654 - RNA, 83 nt, Homo sapiens
aacuggacccaucacaggccucagugggaaacuccagaacaguucugccauucuccacauggugugcugugaguggucuaguu

SEQ ID NO: 54655 - RNA, 59 nt, Homo sapiens
aacugguauuucccaugaauuuguaugguauaguacaaguaacagggauaauagcaguu

SEQ ID NO: 54656 - RNA, 58 nt, Homo sapiens
aacuucugccuguauauccaagcauuuccauacaucuugugaaaucuaggcagagguu

SEQ ID NO: 54657 - RNA, 79 nt, Homo sapiens
aacuugucauuguucacaguacucccuggaauuaaacccccaggguuuuagcugauuccuauugugaguaguuuagguu

SEQ ID NO: 54658 - RNA, 78 nt, Homo sapiens
aacuuuuaucucaaugugucuugacugcacauccaguucccuuuaggaguugagauuuucaaggcacgaauaaaaguu

SEQ ID NO: 54659 - RNA, 74 nt, Homo sapiens
aacuuuugaugucuugcaggcacgagaugaguucacaagcaaucagugcuggaaggaugugcaaaauaaaaguu

SEQ ID NO: 54660 - RNA, 93 nt, Homo sapiens
aagaaaguagagaugcuagcagagaaaugacuuacaagagaaugcuaauagugauuaucucuguggguagugcugaaugauuucuauuuuuuu

SEQ ID NO: 54661 - RNA, 78 nt, Homo sapiens
aagaacugacuuuugauaguuuuaaaauuaaucuuugcaugaagguugguuucgcuuuuauccuuuaaguuuguuuuu

SEQ ID NO: 54662 - RNA, 104 nt, Homo sapiens
aagaauuuuaugguuuuagcucuuauguuuaugucuauaauccauuuuuauuacuaguuguuuuggugcaugaugugaauguaagaaaauccaacuucauucuu

SEQ ID NO: 54663 - RNA, 93 nt, Homo sapiens
aagacagcuguuuuucuccuguagccccaucaucuuuuguucacuaucuggucucuaaaagaaaggugggcaacaggugaccagcaguugcuu

SEQ ID NO: 54664 - RNA, 61 nt, Homo sapiens
aagagauggcucuuucuagacuuaauuauaagcuuaguaguccauuggagagucaauucuu

SEQ ID NO: 54665 - RNA, 60 nt, Homo sapiens
aagagguaggaaauggucauuuuuaguuaaauauugaaaauggugccggguuuaucucuu

SEQ ID NO: 54666 - RNA, 74 nt, Homo sapiens
aagaugaaagguauguuuucugugacauuuuucaauacucaguucugucacaacaaggaaaauauuuuucacuu

SEQ ID NO: 54667 - RNA, 64 nt, Homo sapiens
aagaugauguuguguuuucacuuuguuggugugaauaguugagugaaaauauccaacucauuuu

SEQ ID NO: 54668 - RNA, 79 nt, Homo sapiens
aagauggacaauggauggauagaaggaugauggauggaugugugcauaaaugcuuagaucuguauauaugucuaugcuu

SEQ ID NO: 54669 - RNA, 71 nt, Homo sapiens
aagauuagauggcugugcguggcuuuauuucuggauucucuauucuguuccauugcauacuaucugauuuu

SEQ ID NO: 54670 - RNA, 64 nt, Homo sapiens
aagcaauggcaauguaagucagaaaaauggaagugcuguuuuuggagaauuguauugccagcuu

SEQ ID NO: 54671 - RNA, 55 nt, Homo sapiens
aagcacacagaggcggaaggacauaaaguuccugguugauuucccuuugguguuu

SEQ ID NO: 54672 - RNA, 76 nt, Homo sapiens
aagccagugugacaggaaacuuugugucuucugugugacauaaaaccauccauuguuucuuaaauuccauuuguuu

SEQ ID NO: 54673 - RNA, 75 nt, Homo sapiens
aauaauggagcugugauuugaguccagaucuaacaccacagauguucuuuccucuauguuacgguuccaguuauu

SEQ ID NO: 54674 - RNA, 73 nt, Homo sapiens
aauacaaauaaagugcuuaggauaguguguggcauacguuaggugcuacauaaauguuagcauugcauguauu

SEQ ID NO: 54675 - RNA, 61 nt, Homo sapiens
aauacaagcaguccaacuccauauuccauaugcuuaacgaguaugaugaacugcuuguauu

SEQ ID NO: 54676 - RNA, 80 nt, Homo sapiens
aauacaguacauaaaaugcuuuugaucuuggaaaaguuucuuauaaagguacuucauucucuggaucagaauacugaguu

SEQ ID NO: 54677 - RNA, 130 nt, Homo sapiens
aauacaguggguccuagccacguguggcuaucaagcaccugagauguggcuagagagguugaggaacucaauuuuuaacuaaucuacaucuaaauuuauauagccacauggggcuagaggcuccuguguu

SEQ ID NO: 54678 - RNA, 100 nt, Homo sapiens
aauacaugcuugcuaugacauaauugugaugauugaaauacugugugugacaugacuagcacagugcuuggcacacaguaauaacauagcugccaguauu

SEQ ID NO: 54679 - RNA, 61 nt, Homo sapiens
aauaaaauauccuuauucuuacaaaauccaagcaggaaguggcagugggagauauuuuauu

SEQ ID NO: 54680 - RNA, 61 nt, Homo sapiens
aaguucagauuugacugguuucucaugagccacaugugggaauguagcaaaucugcaauuu

SEQ ID NO: 54681 - RNA, 68 nt, Homo sapiens
aaguuccaaugcacauaaaauccuccagggugcauuuuuacuuuggaagugggugugugugguaacuu

SEQ ID NO: 54682 - RNA, 65 nt, Homo sapiens
aagugcaaauucccaggcucuggcccaagacagucugacuggguggagccugggagucuggauuu

SEQ ID NO: 54683 - RNA, 60 nt, Homo sapiens
aaguggaauguuuguggcacaaagaaaggauacauucuugaggugacagauacuucacuu

SEQ ID NO: 54684 - RNA, 78 nt, Homo sapiens
aaguggauugguuaauuuuuuuacuuuuuguuaccacaaaguucuugcugaaggauuauauuguuuaucaauccauuu

SEQ ID NO: 54685 - RNA, 67 nt, Homo sapiens
aagugggaggaucucuugaggccaggaguucaagacgagccuuggcaacauagugagacccccauuu

SEQ ID NO: 54686 - RNA, 84 nt, Homo sapiens
aaguuaaugggugcagcacaccaacauggcacauguacauauacguaacaaaccugcacguugugcacauguacccuagaacuu

SEQ ID NO: 54687 - RNA, 70 nt, Homo sapiens
aagguuuggcuccguuguacaggcuggagugcagugaugcaaucucagcucauggcagccuugaacgcuu

SEQ ID NO: 54688 - RNA, 84 nt, Homo sapiens
aaguacuucaacagucagcccauccacagacccuaccauacagccuucccagaaucucuggaugcacugauuggugaaugacuu

SEQ ID NO: 54689 - RNA, 87 nt, Homo sapiens
aaguaguccaaagaaucauuguuucuaaguuugugagaaaggauguugauaguuugauaggaacaauggugaaucuguagauugcuu

SEQ ID NO: 54690 - RNA, 61 nt, Homo sapiens
aaguaugucuugagacauacuugagacuggguaauuuauaaguauguaucaagucauacuu

SEQ ID NO: 54691 - RNA, 93 nt, Homo sapiens
aaguauuaguagaugguauuauagguuucuguuccucuacacaguccauuuaaggaggaaaaauaguuuuucuaauaccaucuuaagugacuu

SEQ ID NO: 54692 - RNA, 59 nt, Homo sapiens
aagucaaggagagaagcuucaggagaaaccaacccugcuggcacuuugaucuuggacuu

SEQ ID NO: 54693 - RNA, 113 nt, Homo sapiens
aaguccaugcucuuugccucaguugaaggagccagaauaugcaucccaacuauaggcaaggccacugagaugcauauucuggcuccuucaacugaggcaauaagcauggacuu

SEQ ID NO: 54694 - RNA, 95 nt, Homo sapiens
aaggcagagaccugauucguacaguaguaaaagugaaugaacauuggcaacauuuauucaccauuuauuaugugaaguccugaaaauccugccuu

SEQ ID NO: 54695 - RNA, 86 nt, Homo sapiens
aaggcaguuccuggauuaucaacaauuaauuuucacacaucccuuccacagaaacagucaauugcugaugaccugcagagcuccuu

SEQ ID NO: 54696 - RNA, 73 nt, Homo sapiens
aaggcaugauuguauuuugcucugugauaaggacaugagauucugggauaucaggguaagaauaauaugguuu

SEQ ID NO: 54697 - RNA, 67 nt, Homo sapiens
aagggacagccauggggcgcagccaacggggaguuauaaaggugguuaacagcacaugcugucccuu

SEQ ID NO: 54698 - RNA, 96 nt, Homo sapiens
aagggauaaauauguaauagcagcuugucagggcagacuguauucugauguccccacaugguucuguccccuagaagcuguuuacauuauucucuu

SEQ ID NO: 54699 - RNA, 78 nt, Homo sapiens
aaggaggaucccagcuccagccccuggugcccugggguggguucugcaggacaccugguguggaacuggagucuccuu

SEQ ID NO: 54700 - RNA, 56 nt, Homo sapiens
aaggauaacugaguuugcugcuacccucucucguagcaccaauaaucagaguucuu

SEQ ID NO: 54701 - RNA, 56 nt, Homo sapiens
aaggggugaacacaguacuugauagguuguuuuucaaucacugucuguuuccccuu

SEQ ID NO: 54702 - RNA, 90 nt, Homo sapiens
aaggucagauauguaguaguugaaaaagaaguaggguuaaaaauaauaauaauacccuucccucugacauuaaucauugauauugaccuu

SEQ ID NO: 54703 - RNA, 57 nt, Homo sapiens
gaaagagaggggcugagaugcagaccagucuguucucucaguggcuuccucacuuuu

SEQ ID NO: 54704 - RNA, 68 nt, Homo sapiens
gaaaaugagguuuugcuauaguuaaugcaucucaagauggcauauaauauagaagacuaguaguuuuc

SEQ ID NO: 54705 - RNA, 57 nt, Homo sapiens
gaaaagccucuccucuccagguagacacagccccauuuggggaauggagagguuuuc

SEQ ID NO: 54706 - RNA, 62 nt, Homo sapiens
gaaagugcugagacagacugggaagccuuuggcuaccggcuuccacugucccuggcacuuuu

SEQ ID NO: 54707 - RNA, 65 nt, Homo sapiens
gaaaguuuagauuuuguugcaccacaguuauuuuaauggcuguaauguaaugagacuacauuuuu

SEQ ID NO: 54708 - RNA, 115 nt, Homo sapiens
gaaauaagggaaaaaauccguaaaauguucaaaguuggaggacaaacuguuuaguuuuaauauuuuuaguguauuuaucuuuggaauuuguuuuaugucuuuuuuuuuuuuuuuu

SEQ ID NO: 54709 - RNA, 98 nt, Homo sapiens
gaaaucaucuuaagugcauaucuucuuccucauuuauacauacaaagagcuguauggcaaugcauaggaaggaaauggcacaggaaaugaacauuuuc

SEQ ID NO: 54710 - RNA, 127 nt, Homo sapiens
gaaaugaaacuuagcagauuguagcauauuaucuuuuugauauguaguuggacuugauuuucuugugucuuguugaggauuuuuccaucuauagucaucagugauauugaucuguaguauucauuuu

SEQ ID NO: 54711 - RNA, 111 nt, Homo sapiens
gaacuuucccacagaacauaaauaaaaugcacgcuacccagcuagauuuugguguuagaaaucugugcugcaggagucugcauggcuuuuugaaaugaucugagaaaguuc

SEQ ID NO: 54712 - RNA, 73 nt, Homo sapiens
gaagacaguggucaguugaguccuugccaagccaggcuggcuucgaggaggagugauugaggcgauuguuuuc

SEQ ID NO: 54713 - RNA, 63 nt, Homo sapiens
gaacuauggauguucuagggaugugaugauggaaaauauuacaaaugcccauacaucuaguuc

SEQ ID NO: 54714 - RNA, 56 nt, Homo sapiens
gaaaggaguaaguagguaaaucuugcaaaaugugccuaugaucacuugcuucuuuu

SEQ ID NO: 54715 - RNA, 55 nt, Homo sapiens
gaaauggaucagagcaagcuuuuuuuggucauucaucagucuucugauccauuuu

SEQ ID NO: 54716 - RNA, 104 nt, Homo sapiens
gaaauacuacuuagugguuacguugugguuuuuaaaacuagguggauuuuuuuaauugucuaccuuuaauuuagaugccacgucuuuccaauuaagaauauuuc

SEQ ID NO: 54717 - RNA, 78 nt, Homo sapiens
gaaccaucucuucucaggcuuuucccagagugaugucaacaagacaauucaugugaagggcuugaaucucugugguuc

SEQ ID NO: 54718 - RNA, 112 nt, Homo sapiens
gaagugguacaguuucauggccaguaugcuuauaaacauuugucagagaaauugagcacaccucaggaaauguuuaguggguugaaugcccagggaagcuguuaaacauuuu

SEQ ID NO: 54719 - RNA, 77 nt, Homo sapiens
gaagcuuggcaguggugugugccagccuagguuccagcucccugacccugagcuggcugccacaauugcuggguuuu

SEQ ID NO: 54720 - RNA, 65 nt, Homo sapiens
gaaggaucuggagucuugaugauuuucaaaugaacucaucugaauucucagggucuucuuccuuc

SEQ ID NO: 54721 - RNA, 87 nt, Homo sapiens
gaaggcuuaagaagugagauauucugguuuacuaaaucucuuuauggauucaguauuaaccagaaauuucuuuuuguugagacuuuu

SEQ ID NO: 54722 - RNA, 96 nt, Homo sapiens
gaagggaacacaugauaggucuguuuugaaaaggaauggggacagaacaaaauauuacuaggucugaucaaaagaggcuuguucuggcuugucuuu

SEQ ID NO: 54723 - RNA, 74 nt, Homo sapiens
gaagaugcauuaagggccuggagauacacuggucaacaagacaaguauggugucuccugccuucaugcagcuuc

SEQ ID NO: 54724 - RNA, 55 nt, Homo sapiens
gaagauggaggcugcagugagcugagauugugccacugcacuccagucccgucuc

SEQ ID NO: 54725 - RNA, 55 nt, Homo sapiens
gaagauucaaccaaaccagaacaccaauaaaacggguugacuugguugaauuuuu

SEQ ID NO: 54726 - RNA, 89 nt, Homo sapiens
gaagcaagugcuuuacacaugcaugauuuuaucaaggagauuauggagaccuugaaggccauccaugcauguuaaaaaccuuugcauuc

SEQ ID NO: 54727 - RNA, 78 nt, Homo sapiens
gaagcaaguggccuugagguugacggaauauucugaaacauuacgagaacugaucaauguuaaggcuuauaaugccuc

SEQ ID NO: 54728 - RNA, 56 nt, Homo sapiens
gaagccagagugagcaugaaacucuuccugagaaagacaugugcacuacuggcuuc

SEQ ID NO: 54729 - RNA, 72 nt, Homo sapiens
gaagagaccauucuauguagagggaacagccugagcaagagggcuggaggccugaacauaaaugguguuuuc

SEQ ID NO: 54730 - RNA, 63 nt, Homo sapiens
gaagaggaaguggcauugcaguugagacugagucuguuugccucugcacauccacucuacuuc

SEQ ID NO: 54731 - RNA, 88 nt, Homo sapiens
gaagaggauggaguguggaagucuuugguauugguagucuuaucucagauuuauuguggcuagaauuuuuaccuacuucaugcucuuc

SEQ ID NO: 54732 - RNA, 79 nt, Homo sapiens
gaagcucagagaagggugugauuugccugagaccacacagccgguaacaggcaaggucacaccuugaacccgugucuuc

SEQ ID NO: 54733 - RNA, 104 nt, Homo sapiens
cuugaggcacuguagugaaacuuugucauuaguaacgacuuuugucuaacacagauuaaccaaucaagagucaaaugcuuauguauaaagcacacugcuuuaag

SEQ ID NO: 54734 - RNA, 67 nt, Homo sapiens
cuucugccugagacucagaaugagacuguggaucaugacagaaucaaauuccaagucuagguaggag

SEQ ID NO: 54735 - RNA, 70 nt, Homo sapiens
cuugaacccaggaggcggaaguugcagugagccaagauugugacauugcacuccacuccugaacaacaag

SEQ ID NO: 54736 - RNA, 69 nt, Homo sapiens
cuugaacccaggaggcggagguuguggugagccaagaucacgccauugcacuccagucugggcaacaag

SEQ ID NO: 54737 - RNA, 57 nt, Homo sapiens
cuugaacuagccauaaagaagccuuugcucuuagaagguucauguaauuaguucagg

SEQ ID NO: 54738 - RNA, 69 nt, Homo sapiens
cuugaacucaggagguggagguugcagugagcugagauugcgcuauugcacgccagccugagcaacaag

SEQ ID NO: 54739 - RNA, 130 nt, Homo sapiens
cuuccaaaauaucuucuaaauauauguuguagauuaaguugugccugaaaacuuguaaucacaaaaaaaucacaaguaucaaauauaaacuuguauuuauucagcagcucaccugaucauuauuuggggg

SEQ ID NO: 54740 - RNA, 84 nt, Homo sapiens
cuucgcagucagguauuucugaggaagagacauaugaaacgcaugugguuuuucacauuuagagaaagugacgacuguaagaag

SEQ ID NO: 54741 - RNA, 125 nt, Homo sapiens
cuucggccucccaaaaugcugggauuacaggagugaguuacugcacccaucaucuguucuuuuaaaaauccauggccgggugcgguggcucacaccuguaaucccagcacuuugggaggccgagg

SEQ ID NO: 54742 - RNA, 56 nt, Homo sapiens
cuucucagugcucaucuuauuuaauauuggcagugggacugugaugcauugaggag

SEQ ID NO: 54743 - RNA, 55 nt, Homo sapiens
cuucuggaagcuccaaggaagaaucuguuucuuugcgcuuugcagcuuccagagg

SEQ ID NO: 54744 - RNA, 71 nt, Homo sapiens
cuucuggcuggggcacagucugaauguuucugaauccagcaaagaaugcagauuugccucagggcuugaag

SEQ ID NO: 54745 - RNA, 90 nt, Homo sapiens
cuuccgcuguaauucauuuacugaacacccacuaggugcuaaggaccaagccagguggugguauuucagaaaaugaggacacauuugaag

SEQ ID NO: 54746 - RNA, 56 nt, Homo sapiens
cuuccugcagaagcacacagccucaggagcuuccgaacugugcauuucuguggaag

SEQ ID NO: 54747 - RNA, 64 nt, Homo sapiens
cuuccuucacuuuuuaugccagauugagacaguuucuucuauuuggguaaugagugcaagggag

SEQ ID NO: 54748 - RNA, 73 nt, Homo sapiens
cuucacauauaaauacaacauguguuaaaggacuaaauuucuagugucacaguuuguacuuuauaguuugaag

SEQ ID NO: 54749 - RNA, 129 nt, Homo sapiens
cuucagccucccaaagugcugggauuacaggcaugagccacugugccuggcccaauuuuuuaaaugauacaaaaaguagcuggaugcaguggcacauaccuguagucccagcuacuugggaggcugagg

SEQ ID NO: 54750 - RNA, 120 nt, Homo sapiens
cuuacuauucacaaacacaucaaggaauuuuucuuuaaucaggucaaaauaaaguauuuucuaacacugauauauugaaugaugaaacagaguccuuugaggauuaaaugaaguaguggg

SEQ ID NO: 54751 - RNA, 82 nt, Homo sapiens
cuuacucaacuuuauggcauucuguauaacauugcuccugaccaaggagcuuguuuuauagaaagucaaguguaccagugag

SEQ ID NO: 54752 - RNA, 130 nt, Homo sapiens
cuuaggagugacuuggcaaugcgggcccuuuuuuguuccauaugaacuuuaaaauaguuuuucccaauucugugaagaaagucauugguagcuugaugggguuggcauugaaucuauaaauuaccuuggg

SEQ ID NO: 54753 - RNA, 69 nt, Homo sapiens
cuuaggguugcaauaaaauaucuguacucaauaacuauucauugaaugauggaguaauguaaucuugag

SEQ ID NO: 54754 - RNA, 61 nt, Homo sapiens
cuuauuagaaagaaaagacaugguggguuuuuuccccuuuauucuuugcuuuucuaagagg

SEQ ID NO: 54755 - RNA, 66 nt, Homo sapiens
cuucaaguguggccaccugaccagcucccaagacaacacugcuugucaggggaccauacauugaag

SEQ ID NO: 54756 - RNA, 90 nt, Homo sapiens
cuuggauaugucuuuaucagcagugugaaaauggacuaauagaguaaauuuguauuaguagaguggggcgcugcugaaaagacauccaag

SEQ ID NO: 54757 - RNA, 82 nt, Homo sapiens
cuuggaucucagugcuuguuauuguucuauucggguuuuuaauuucuucagaguuuaauuauagcagguucuuuugucuagg

SEQ ID NO: 54758 - RNA, 89 nt, Homo sapiens
cuugauuugaaaaaaaugcugcccugauuuuacauauauccaggauggauaugucuauuauuagggcagguuaugagggauaagucaag

SEQ ID NO: 54759 - RNA, 86 nt, Homo sapiens
cuugccaagugcauggagcaacagaccuaucacaguuacagccccacggcacuggaagugucugugcccagcucugcugacccaag

SEQ ID NO: 54760 - RNA, 84 nt, Homo sapiens
cuugugggcauuuagugcuauaaauuucccucuacacacugcuuugaaugugucacagagauuuugguauguugcaaacacaag

SEQ ID NO: 54761 - RNA, 59 nt, Homo sapiens
cuuuaucauagugcaguuuucugacuccugugucagggucaccugccgcuguggaaggg

SEQ ID NO: 54762 - RNA, 60 nt, Homo sapiens
cuuuaugagguuggauggaucugggcuugaauccugauucauuuucuacuuugcuugaag

SEQ ID NO: 54763 - RNA, 86 nt, Homo sapiens
cuuuauuucuggcuuugccuuugugauauggucuaucagaugauugauaaaaucuaucuagaguaaggauauaagacaaaauaaag

SEQ ID NO: 54764 - RNA, 84 nt, Homo sapiens
cuuucaugguggguuccugagacugaggagcuuuggacggaugcuuggcuguugggaaugucccagucacaggacacuguaaag

SEQ ID NO: 54765 - RNA, 65 nt, Homo sapiens
cuuucucagugagacccgagaugcuauguaagucuaacaaccaccucacugcuguacuggggaag

SEQ ID NO: 54766 - RNA, 57 nt, Homo sapiens
cuuucuccaaucuaagggaagaaggccugguuuuuguauguuggagauuggagaagg

SEQ ID NO: 54767 - RNA, 69 nt, Homo sapiens
cuuucugggggugcugauggaaacuccuacccaggcaaaucuuguuucccaggcauucccccagugaag

SEQ ID NO: 54768 - RNA, 130 nt, Homo sapiens
cuuucuuugaagcaucauauauuuuagguugguguaacaguaauugcaguuuuugccauugaaaguaauggcaaaaaucacaaguaccuuuguaccaacauaacagauaagaaaauucaucagaagaaag

SEQ ID NO: 54769 - RNA, 66 nt, Homo sapiens
cuuugaaacuuacuguuaauuuucugucucguugaucugucuaauguugacaguggguuguuaaag

SEQ ID NO: 54770 - RNA, 66 nt, Homo sapiens
cuuugaaacuuauuguuaacuuucugucucguugaucugucuaauguugacaguggguuguuaaag

SEQ ID NO: 54771 - RNA, 85 nt, Homo sapiens
cuuugaauugugacuaggagauauguuuucuucagcuuuggcugcaucaaggagaagauacaaauuucuuagaugcggaucaaag

SEQ ID NO: 54772 - RNA, 61 nt, Homo sapiens
cuuuuaacauuaaaucuuauucuacuguaguaacaauauaaguggaaugaaauguuagggg

SEQ ID NO: 54773 - RNA, 67 nt, Homo sapiens
cuuuuaaugagguaaaggacaauguuuugauaaguauuaaugcacauuuauuuuaccuuucugagag

SEQ ID NO: 54774 - RNA, 55 nt, Homo sapiens
cuuuucuugugauucagcaaguaggaaacacucuuuuugcagaaucuaagaagag

SEQ ID NO: 54775 - RNA, 80 nt, Homo sapiens
cuuuugagaagcuugaccugcagauucuuacaguccaaguuuugcugugguuugugaauggaguagcaggaucacagaag

SEQ ID NO: 54776 - RNA, 101 nt, Homo sapiens
cuuuugcuuuaguuuauagacugguuuauuauacaguuuauuuguaaauuuggcucaucauagaauguauuaguaaauuuguccauaggcagaagccagag

SEQ ID NO: 54777 - RNA, 96 nt, Homo sapiens
cuuuuuuaaaaauucuaacgacuuccauaauuugcaucucaucuauucaggugagguaggaaaaguuaggaaugguuuguuauuauuuauaaaagg

SEQ ID NO: 54778 - RNA, 125 nt, Homo sapiens
gaaaaaugacuccagaaucuuuaaaucugcucuacuguauagauggaguugauuuuuaaaaguugaaaaauauuauaagaugauuuuauuuacaguaaguugacuuaggauuggacuuauuuuuu

SEQ ID NO: 54779 - RNA, 128 nt, Homo sapiens
cuuugauuuugacgagcaaaagcccuuguuagcauauaccaugcaguccaauaugcacauauuggaauauaugcauauuggacugcauggcauauccuaacaagggcuuuugccuguuaaaaccaaag

SEQ ID NO: 54780 - RNA, 58 nt, Homo sapiens
cuuugggagaaacguaguuuauaguuuaaacaaagacaguaacagcacuuucccaaag

SEQ ID NO: 54781 - RNA, 58 nt, Homo sapiens
cuuugguguauuuucagagaccaaauuuuaggucaguggucucccagaaucacuaaag

SEQ ID NO: 54782 - RNA, 126 nt, Homo sapiens
cuuugucaugcucguugauacacacucccaccuagcgccuugcacucagaagauucaguucauauaucuguuaauugacucuaacugacugagguucccuggaugaggagagcaaugagaacagag

SEQ ID NO: 54783 - RNA, 58 nt, Homo sapiens
cuuuguggcuccugcaggccauuuggauguauacgggcaggucacagggguuacaagg

SEQ ID NO: 54784 - RNA, 99 nt, Homo sapiens
gacauaguugaguuugggguccugagauauuauuucccuuucacaguaguauauaguguguggguaguagauuucauuuugcagauuauaauuacuguc

SEQ ID NO: 54785 - RNA, 64 nt, Homo sapiens
gacauccacaugcaguuggaaacaggcaguugaacacaccuguuugaagcucaugggugagguc

SEQ ID NO: 54786 - RNA, 76 nt, Homo sapiens
gacaugauuaaguauuaugugcugcauuuugagacaauccaaaaugugaaagccuauaacgacugacuguuguguc

SEQ ID NO: 54787 - RNA, 86 nt, Homo sapiens
gacagggaugcuguuuggagcuucuggcaugcccccauaggugaaucacaauggaggccuacagaauuuuggagcaaggcccuguc

SEQ ID NO: 54788 - RNA, 109 nt, Homo sapiens
gacaggggacgaugcacaggacaggaguguguaggagaaagguaaccacgaucuaaucagucaaucuugccuguaacuguugccauguuuguguguuugugucccuguc

SEQ ID NO: 54789 - RNA, 64 nt, Homo sapiens
gacaggugagcuuucucauccgacuucauacccuuuuguuguugagauagggucucacucuguc

SEQ ID NO: 54790 - RNA, 57 nt, Homo sapiens
gacagagaucaugcaacugcucgccuuaggaggcgaaagucaacagguacucgaguc

SEQ ID NO: 54791 - RNA, 95 nt, Homo sapiens
gacagagucucgcucuauugccuaggcuggagugcaguagcaugaucucaucucacuacaaccucugccucccagguucaagcgauucuucuguc

SEQ ID NO: 54792 - RNA, 80 nt, Homo sapiens
gacagagugaauauuauauaaggcugaauaauauucuauuguauauauacaucaugucuuguuguauuuauuuaccuguc

SEQ ID NO: 54793 - RNA, 96 nt, Homo sapiens
gacaggagaaucacuugaacccaggaggcggagguugcagugagccgagaucgcaucauugcacuccagccuuggcaacaagagugaaacuccguc

SEQ ID NO: 54794 - RNA, 91 nt, Homo sapiens
gaaucuauggcccauuacccagaggaacguuuggauugauuaucagaaguacacuucaaggaauucaaauuuucucuggagucauagauuc

SEQ ID NO: 54795 - RNA, 73 nt, Homo sapiens
gaaugaggucacgugcuauuugccuuucugauaccuggccuaugucacuaaagaaaauggcauggacgcauuc

SEQ ID NO: 54796 - RNA, 66 nt, Homo sapiens
gaaugcaggaaugcacaugccuucgauacacaaaccaaaaaugauacaaugugcaauuuuguauuu

SEQ ID NO: 54797 - RNA, 65 nt, Homo sapiens
gaaugccugagaggauaugauccccuugaagcugauuacaggguagacauacaucucagccauuc

SEQ ID NO: 54798 - RNA, 77 nt, Homo sapiens
gaauaccaagugaaugaugugaaguguaaaccaaccauuguuguguuucauguuacugucauacacuuguuuccuuc

SEQ ID NO: 54799 - RNA, 67 nt, Homo sapiens
gaauagaauguauauucuguaguuguuggguagaauguucuauaaguauccauauauacauuuguuc

SEQ ID NO: 54800 - RNA, 81 nt, Homo sapiens
gaauagggaccuuagaauuguauguauguuucuaggcuaauauuugcaagacaugucuaagguuuaaaguuuuuccuauuc

SEQ ID NO: 54801 - RNA, 79 nt, Homo sapiens
gaauauaaacaguaggcuaaagcuauaucuuacccucaaaucugggugaaaugaucaguuugguuacugcuuuauauuu

SEQ ID NO: 54802 - RNA, 58 nt, Homo sapiens
gaaucacugugguaucccaugcuuggaaugucaguaaagguguggccaauagugauuu

SEQ ID NO: 54803 - RNA, 60 nt, Homo sapiens
gaaucauugagagacugagcuauauaauacuuguauagagcugugucuucuuaaagauuu

SEQ ID NO: 54804 - RNA, 60 nt, Homo sapiens
gaauccauguguacuccauguuuuccacuuauaagugagaacauacggcauuugguuuuc

SEQ ID NO: 54805 - RNA, 65 nt, Homo sapiens
gaaguuuaguguuuugaaacauauagaagcaaacacugcuucuauguuugaaaaugccaaauuuc

SEQ ID NO: 54806 - RNA, 122 nt, Homo sapiens
gaaguuuccucagcugggaggggaaggacauggaguguaauauugagagcugcagcuguguguuuggcuagggcuuccacuugcagcuccauaucaacuuuggcugccugugaggaaauuuu

SEQ ID NO: 54807 - RNA, 56 nt, Homo sapiens
gaaugucauauaauuggaaucagccuuuucaaauuggcuucuaauaauaugcauuu

SEQ ID NO: 54808 - RNA, 67 nt, Homo sapiens
gaauguucaguagucaaaagauaagggucauagggguuuugaugucuugucaaucuauuuaacauuc

SEQ ID NO: 54809 - RNA, 95 nt, Homo sapiens
gaauucauaggaguuugggauucauaucaagucuuagaguuuaagugucauaagcugauggucuuguaugaugucauuacuccuauuauguauuc

SEQ ID NO: 54810 - RNA, 63 nt, Homo sapiens
gacaaauuuguaaauggguauucagugggaagugacugaacaaaaccauucaacagauuuguc

SEQ ID NO: 54811 - RNA, 56 nt, Homo sapiens
gacaagaaaagauuguuccuguuuucuccuuuuaggaaguaacuaucuuuucuguc

SEQ ID NO: 54812 - RNA, 106 nt, Homo sapiens
gacaaggaacaaauucucccucggaggcuccagaagaaaccaaccaugccaacaccuugauuuuggucuucuggccuccagaaccgggagagaauauauuucuguu

SEQ ID NO: 54813 - RNA, 55 nt, Homo sapiens
gacaauauuaagagaagacagcccauguuaauggauugaaagcuuuaauauuguu

SEQ ID NO: 54814 - RNA, 80 nt, Homo sapiens
gacaaucagaauaugcaucuaucuagugagcagagggaugacuuugaauagaauggaaggcauguuugcccugagcaguu

SEQ ID NO: 54815 - RNA, 64 nt, Homo sapiens
gacaauguuauaaaguaugagaccugaacaaaaauuucaggugcuuacuuaauagccauguguc

SEQ ID NO: 54816 - RNA, 90 nt, Homo sapiens
gacacagugagaauugcucaaaucaguacuugagugguucaauguuaaggugaauuucagguacaauuugagccagagguucauaguguc

SEQ ID NO: 54817 - RNA, 78 nt, Homo sapiens
gacaccuaacaauuauucagugacuuaagagauauacuagucuguuucuuagucauguaauaguccagguuagguguu

SEQ ID NO: 54818 - RNA, 60 nt, Homo sapiens
gacaccuugauugcagccuugugaaucagaagauucacuguuaagcaguuaaacuguguc

SEQ ID NO: 54819 - RNA, 58 nt, Homo sapiens
gacacgcugugacaguccagccaucaguuuugccgaugaacuggaugucgaguguguu

SEQ ID NO: 54820 - RNA, 58 nt, Homo sapiens
gacccugcugaucaggucuuaaaguccaaaacucaugagaugucugauugcgaggguc

SEQ ID NO: 54821 - RNA, 56 nt, Homo sapiens
gacccuggcuaccugguaggcggaaccaugucacuugugccauguagcacaugguc

SEQ ID NO: 54822 - RNA, 71 nt, Homo sapiens
gacgugaguuuugggggggcugguaaaagaaugcuaugguuugaguauuuguccccuccaaaagucauguu

SEQ ID NO: 54823 - RNA, 64 nt, Homo sapiens
gacuaggagagcagcugcccauggcucgaagccuuccaacucgugggcaguggcccaccugguc

SEQ ID NO: 54824 - RNA, 62 nt, Homo sapiens
gacugaucuuaucuccugauaccucccuuucccugaggcccuucacaagccaagaucacguc

SEQ ID NO: 54825 - RNA, 70 nt, Homo sapiens
gacugugaaaugcaagguauauucaugagagaacugcgacucucacaugaagauuuuaguauacacgguu

SEQ ID NO: 54826 - RNA, 57 nt, Homo sapiens
gacuuaaucaucauuuaaaggcccaaccuguaaagcuaucacauuggugauuaaguu

SEQ ID NO: 54827 - RNA, 80 nt, Homo sapiens
gacuugucuguguauuacuugucugugucucaauuuccucaucuucuaaaaugagaauacagcaguaaccacuggcaguu

SEQ ID NO: 54828 - RNA, 125 nt, Homo sapiens
gacuuuaauucuggcacuauguauggcucucugggucuggguuuguguugccuaugccugcagaugguguagcagccauaaacacagugagcagaacagcaaaucagucaguuuuuggaacaguc

SEQ ID NO: 54829 - RNA, 62 nt, Homo sapiens
gacuuugucuugcauccuacauacaagcucaaccacaguagaauagggcacgaggcagaguc

SEQ ID NO: 54830 - RNA, 129 nt, Homo sapiens
gagaaaacugaggcacaggaaagaaaguaccuuauccaagaucauacagcuaguaaguguaagagauccaucgucuccuguacuuucuaaguuguuucaucaguuagguuccuucucucuuauuuucuu

SEQ ID NO: 54831 - RNA, 71 nt, Homo sapiens
gagaaagcuacauuuuauuuaugucaguguguaaaauuauaaccugauaaugaaagaaauacaguuuuuuc

SEQ ID NO: 54832 - RNA, 90 nt, Homo sapiens
gagaggaucacaugagccugggagguugaggcugcaauggguugugaucgcaccauugcacuccagccuaggcaacagagugagacuguc

SEQ ID NO: 54833 - RNA, 89 nt, Homo sapiens
gagaggaugcaggugacuuuucugagacaaugcuuugcagcuuguaugagauucuuagagaagucugguccucccugccccagccucuc

SEQ ID NO: 54834 - RNA, 80 nt, Homo sapiens
gagaaguagugguccaguuuuguuaacauaugguuauccagcugucugagcaccauuuguugagaagacuguccuuucuc

SEQ ID NO: 54835 - RNA, 67 nt, Homo sapiens
gagcaacacuguuuauuggauagcccuaaagaacccuuuacuuggcaucuagggaacauguauguuu

SEQ ID NO: 54836 - RNA, 91 nt, Homo sapiens
gagcagaaaucaguuaucguacauacuucacagacuuuaaaguuuuuugcacuuuacuccucagugauaugugaacauggugucacugcuc

SEQ ID NO: 54837 - RNA, 62 nt, Homo sapiens
gagauccaucucacaugcaaugauacccauggguucaaaguaaagggauggagacaggucuc

SEQ ID NO: 54838 - RNA, 59 nt, Homo sapiens
gagaucugggguuggcaaaguuuggcccuugggccgagucuggccugcugccaguuuuc

SEQ ID NO: 54839 - RNA, 99 nt, Homo sapiens
gagauggagucuugcucugucacccaggcuggagugcaguggcaggaucucggcucauugcaaucuccaccucccggguucaagcgauucuccugccuc

SEQ ID NO: 54840 - RNA, 66 nt, Homo sapiens
gagauggaguugucgccugggcuggagugcaauggugugaccucggcucacugcaaccuccaccuc

SEQ ID NO: 54841 - RNA, 99 nt, Homo sapiens
gagauggggggaucacuugaggccagaagugugaggcuacagugaccuauaauugugccacugcacuccugccugggugacagagugagucccugucuc

SEQ ID NO: 54842 - RNA, 59 nt, Homo sapiens
gagauggugugcuguuggaaguggcuucaauccaaggcuuccaacaacgacaccgucuc

SEQ ID NO: 54843 - RNA, 78 nt, Homo sapiens
gagauuagacuguccagacccuauauaucauaguuacacaagcugaccccaugguauggaaggucuggaggacaucuc

SEQ ID NO: 54844 - RNA, 87 nt, Homo sapiens
gagauuggaaagcccuuuaaaguaugauauagaagucauaaacaauaugacuauaggauaacaugcauuuuuaaguuuuucaaucuu

SEQ ID NO: 54845 - RNA, 73 nt, Homo sapiens
gagaaaucuccacacuguuuuccauggggguugaacuaauuuacauucccaccaacaguguacaaguguucuc

SEQ ID NO: 54846 - RNA, 87 nt, Homo sapiens
gagaaucgcuuaaacccaggagguggagguuguggugagccgaaaucacaccauugcacuccagucugggcaacaagagugaaacuc

SEQ ID NO: 54847 - RNA, 86 nt, Homo sapiens
gagaaucgcuugaacccgggaaguggagguugcagugagccaagauugcacuguugcacuccagccugggcaacagggcgaggcuc

SEQ ID NO: 54848 - RNA, 69 nt, Homo sapiens
gagaaugugguuuuaguaaaacuauguuagcaguuaagguuagagcaaaguucaggaaagccauaucuu

SEQ ID NO: 54849 - RNA, 100 nt, Homo sapiens
gagacaagagaauugcuugaacccuggaggcugagguugcagugagucgagauggcgccauugcacuccagccugagggacaagagcaaaacucuuucuc

SEQ ID NO: 54850 - RNA, 56 nt, Homo sapiens
gagacacugggauucuuuugaucugggaucccauguuccugagauucccaguucuc

SEQ ID NO: 54851 - RNA, 100 nt, Homo sapiens
gagacaggagacucgcuuguacccggcaggcggagguugcagugagccaagauugcgccauugcacuccagccucggcaacaagagcgaaacuccgucuc

SEQ ID NO: 54852 - RNA, 70 nt, Homo sapiens
gagacagggucuugcucugucgcccaggcuguguaguggcgcgaucucggcucagugcaagcucugccuc

SEQ ID NO: 54853 - RNA, 82 nt, Homo sapiens
gagacauaaaacuggcuagggucaaacgucaucuugaagguuuuuaaggaaagcauuuaauucagcggcagauuuaugucuu

SEQ ID NO: 54854 - RNA, 62 nt, Homo sapiens
gagacauugagaguuucgcugggauuaagaccacauggacuuaacagcuccacuccauucuc

SEQ ID NO: 54855 - RNA, 59 nt, Homo sapiens
gagacguguaggaggcagagugaaaggcuuguuguuagagcugugcuuaauacacuuuc

SEQ ID NO: 54856 - RNA, 69 nt, Homo sapiens
gagacucuccuucaguccaguggguuuugaggcagagccucagaauacagaacugaggaaucaugucuc

SEQ ID NO: 54857 - RNA, 130 nt, Homo sapiens
gagacuuggaaaaguaguucaaauaugcagccuaacagauaaagaugguuucauuuggcuguuagucuauugagauaauuuacuuguugaggaauguuuauuuaauguuuccauaaaaaauugaagucuc

SEQ ID NO: 54858 - RNA, 63 nt, Homo sapiens
gagacuuuaucaugucuguguguaccuaggcaaugccuaguacagauggcaugcuguuuucuu

SEQ ID NO: 54859 - RNA, 60 nt, Homo sapiens
gagagaggaguauagcacugaccauauagccaggaucaguaaaugcuguucucuuuucuc

SEQ ID NO: 54860 - RNA, 65 nt, Homo sapiens
gagagaugguagucacauaugagcugugaagcugguuuacaguguagugacugccaacuucuuuc

SEQ ID NO: 54861 - RNA, 56 nt, Homo sapiens
gagagcaagaugcaaauggaggcuuaauaagagcuugcauauuggaacuuucucuc

SEQ ID NO: 54862 - RNA, 73 nt, Homo sapiens
cucuugaacccaggaaguggagguugcagugagcugagauagcaacacugcacuccagccugggcaacaagag

SEQ ID NO: 54863 - RNA, 74 nt, Homo sapiens
cucuccugugucaggcacuaguaagaaaaaggcacaacgcuuuuuccucguagagccuaaugucuagaggggag

SEQ ID NO: 54864 - RNA, 64 nt, Homo sapiens
cucugcauuuaagaaagggagggaagagugaaaaggacucugucuugugguuugagugccaggg

SEQ ID NO: 54865 - RNA, 66 nt, Homo sapiens
cucugccagucauauuacccaauacuuuaacauccacuagauauugcagaaugugaguuggcagag

SEQ ID NO: 54866 - RNA, 74 nt, Homo sapiens
cucugccucucaagaugcugggauuacaggcaugagccacuaugcccauuguaauugguguuuuugaagaagag

SEQ ID NO: 54867 - RNA, 100 nt, Homo sapiens
cucugccugucucccaggcuggaguguaguggcgcgaucucgggucgcugcaagcucugccucccagguucgcgccauucuccugccucagccaccagag

SEQ ID NO: 54868 - RNA, 93 nt, Homo sapiens
cuccccauucccugagagcagggucuuucucucccucucugaagacuaagccagaguaaugagacucaccuuugcucugcaguaggugaggag

SEQ ID NO: 54869 - RNA, 72 nt, Homo sapiens
cucuaaguagcagaauaucagauaauuuuaauuuuuuuugagacaggucuuacucuguuacccagguuagag

SEQ ID NO: 54870 - RNA, 61 nt, Homo sapiens
cucuaauuccagcacuuugggugaccgaugagagaggaucacuagaguccuggaguuugag

SEQ ID NO: 54871 - RNA, 76 nt, Homo sapiens
cucucauaagcaauuuccauucagguucaagucaucaucgagaggagaugaugccuagagucaguggaggugagag

SEQ ID NO: 54872 - RNA, 60 nt, Homo sapiens
cugacauaauaaaugccuguuguuuuaagccacugagugugggggcauuucguuaugcag

SEQ ID NO: 54873 - RNA, 76 nt, Homo sapiens
cugacccagcucaguuauagcauuaguggcagcaggguugcuugugccacuccagcucuagcuuuagguggcucag

SEQ ID NO: 54874 - RNA, 83 nt, Homo sapiens
cugaugagggcuugggaugggggauucccugaugguuaauaucagauugacuagggacauucuuccacgccagccaaucucag

SEQ ID NO: 54875 - RNA, 104 nt, Homo sapiens
cugauuuuuguauguggauuuuauauccugaagcuuuacugaauucauuuaucaagucuaagaguguuuugguggagacuuuaggguuuucuagauauaaucag

SEQ ID NO: 54876 - RNA, 81 nt, Homo sapiens
cugcaccaccucuccuccagcuaguauaagcauggagugagaagcugugugccuaguggaaggagagcaaagugagugugg

SEQ ID NO: 54877 - RNA, 105 nt, Homo sapiens
cugacgugagagaaucgcuugaacccgggaguuggagguugcagugagccgagauugcaccauugcacuccagcuugggcaacaagagugaaacucuugucucag

SEQ ID NO: 54878 - RNA, 59 nt, Homo sapiens
cugacuuccuagccuucugguugaccggcagccccagugaccacagcagggaaugucag

SEQ ID NO: 54879 - RNA, 103 nt, Homo sapiens
cugagacagaguuucgcgcugucgcccaggcuggaguacaguugugugaucucagcucacugcaacauccaccuccuggguucaagugauucuccugccucag

SEQ ID NO: 54880 - RNA, 55 nt, Homo sapiens
cugagauggagucucgcauuguugcccaggcuagagugcaguggcgccaucucag

SEQ ID NO: 54881 - RNA, 116 nt, Homo sapiens
cugagcauacuggugugcaccuguagucccaccuacuuggggacugagaugggaggauaacuugagcccuggagguggaggcugcagugagccaugaucauaccacugugcuccag

SEQ ID NO: 54882 - RNA, 67 nt, Homo sapiens
cugagcccagaaguuagaggcugcaaugagccaugauagugccauugcacucuagucugggugacag

SEQ ID NO: 54883 - RNA, 56 nt, Homo sapiens
cugaggacaucagggaagcauccucagaggagaagauuguuuaauugagucuucag

SEQ ID NO: 54884 - RNA, 103 nt, Homo sapiens
cugaggcaggagaaucacuugaagccaggagauggagguugcagugagcagagaucgcgccauugcacucuaucccggugggcagugcgagacuccaucucag

SEQ ID NO: 54885 - RNA, 102 nt, Homo sapiens
cugaggcaggagaaucgcuugaaaccagggggcggagguugcagggagccgagauugcgccauugcacuccagccugcugacagagugagauuccgucucag

SEQ ID NO: 54886 - RNA, 104 nt, Homo sapiens
cugaggcaggagaauugcuugaaaucaggaggcggagguugcagugagcugagaucaugccauugcacuccagcucugggcgacagggcaagacucagucucgg

SEQ ID NO: 54887 - RNA, 112 nt, Homo sapiens
cugcuuaccccuaauuucuuacuuuucuacagugaacgauuucuaaauuacuuauuuucuaacuuuuaggagucuuagcugugaagggaagaaaaaaaacaugggauggcag

SEQ ID NO: 54888 - RNA, 61 nt, Homo sapiens
cugcuucucaauaccaugugaauuaguuaaauuacauggcaauugggaaauaaaguugcag

SEQ ID NO: 54889 - RNA, 60 nt, Homo sapiens
cugcuuuuucuaggaggacaauuauauuuuugauuaauauuguaauuuuagagaaagugg

SEQ ID NO: 54890 - RNA, 61 nt, Homo sapiens
cuggaagguaauugucagcucauagcuuaagcugugggacuguucauuugccuugacccag

SEQ ID NO: 54891 - RNA, 62 nt, Homo sapiens
cuggaaugucagcuacaagagggcagggacuguggcuauuuuguucucugcuacauucucag

SEQ ID NO: 54892 - RNA, 85 nt, Homo sapiens
cuggacaaaagaucucugagaaauuucuuugugaugugcgcauucaucucacagaguugaacuuucuuuugauugagcaguccgg

SEQ ID NO: 54893 - RNA, 113 nt, Homo sapiens
cugccuuuggggcuccaguccaugccucaggugucacauggcacugcgggcuucuugguugccaagaggcagaccacaggccaucuuggggaggacuuuauauucaagugcag

SEQ ID NO: 54894 - RNA, 84 nt, Homo sapiens
cugcauucccuguccugcugugaggugugaccaccugauggccccauuccaguguguucauccucagagaugucaagaaagcag

SEQ ID NO: 54895 - RNA, 63 nt, Homo sapiens
cugcauuugcacugagacucagcuuccaguucagugaggacagccgggcuaguguagaugcgg

SEQ ID NO: 54896 - RNA, 95 nt, Homo sapiens
cugcuaacaguauauugaacagugcauuccuguccauauucuagacacuccuaaagcauuggcagggaugcauuacguggcaauaauuauagcag

SEQ ID NO: 54897 - RNA, 97 nt, Homo sapiens
cuggcccuuccugccauacccagcugcagucaucuucuagaaagcuucccccugcugcuucuggaaaucagcagagggugggcaagggggaagucag

SEQ ID NO: 54898 - RNA, 129 nt, Homo sapiens
cuggcugagaccugucaccauuugaguuugugaacucugaucuacguaugaaguucuacuggcuccgaggagcugugauucuguguagauagucuugcauacugcuaaaauagguuuuuuacuuuccag

SEQ ID NO: 54899 - RNA, 110 nt, Homo sapiens
cugggaagaccuuuccgucggucugucagucugucccugccuggcgggcuuucucugggaaccgcugcagacgcgcuggcgaaagcaccaccgccaagagucaugcucag

SEQ ID NO: 54900 - RNA, 91 nt, Homo sapiens
cugggagaugcuaugguguuauuuuugcacuacaagggcucugaagacugccaggcuugaagugaagaacaauaucaccugccuaucccag

SEQ ID NO: 54901 - RNA, 82 nt, Homo sapiens
cuggggcuuuuuggaggagguuagaucaugaggaaggaggcuucauaaauaugauuuaauguccuuauaaaagacaucccag

SEQ ID NO: 54902 - RNA, 83 nt, Homo sapiens
cugggugggcaucugcugggugcgcuccuguuaugcuuucugcugugacagagaagcauugaguucaguuuaaugucccccag

SEQ ID NO: 54903 - RNA, 83 nt, Homo sapiens
cugguaagucuuguaggcaguuucaugagguaguuaaugauguccaguguaugaaauugcuaucgcaguacuauuacugccag

SEQ ID NO: 54904 - RNA, 70 nt, Homo sapiens
cugggcuauguaggaguggaguuuucaacacacaauuuucaaauggguaauugcacuaagcauaguccag

SEQ ID NO: 54905 - RNA, 69 nt, Homo sapiens
cuggggauggggaagcuguuucuucugguaagaaaguuucaucagaguuuacaagcucaguguccccag

SEQ ID NO: 54906 - RNA, 64 nt, Homo sapiens
cuggucaaccuugugugaaggcaaguccugcauugccuaacaggcaauauugccuucagacuag

SEQ ID NO: 54907 - RNA, 109 nt, Homo sapiens
cugguccugccuggagccugucuacagugauaggugauagguuugugcaguguguucauugcugcaaacaggcaucugugggggcagccugcagggaggauugaaccag

SEQ ID NO: 54908 - RNA, 110 nt, Homo sapiens
cuggagaaacuggggcaguugagcaacaucugagaucaaggcaaaacaaaaugcuugguaaacuuccccucaugaaugaguucuuggcugguacuccuuauuuuuuccag

SEQ ID NO: 54909 - RNA, 66 nt, Homo sapiens
cuggaggggaccuugggacaagggcuucuuugguagcccuggccagguucacaggcuuccuuucag

SEQ ID NO: 54910 - RNA, 55 nt, Homo sapiens
cuggagugagaacuucaaugauggccauuaggccaauuggauggucuuuuuccgg

SEQ ID NO: 54911 - RNA, 57 nt, Homo sapiens
cuggauauguugcaacauuucccacuaauuacuuggugacuggugucagauguccag

SEQ ID NO: 54912 - RNA, 74 nt, Homo sapiens
cuggauauuucccauuucccccaaaugcagccugguaaccacuguauuuguuguuaaauggagaggauuucuag

SEQ ID NO: 54913 - RNA, 55 nt, Homo sapiens
cuggaucuuguccaagaccauuaaggcaguaccacuaugagucugcaagaaccag

SEQ ID NO: 54914 - RNA, 62 nt, Homo sapiens
cuggaugucaaagaggaaaacuggauguccuucuccagaagcggucaucaaguuccuccuag

SEQ ID NO: 54915 - RNA, 61 nt, Homo sapiens
cuggcaagaggauaaaguccuaacuccuuaucauggaguccaaacuauaucuacuuuccag

SEQ ID NO: 54916 - RNA, 78 nt, Homo sapiens
cugcucgggcccuagcuucuagaacucuuuucagcucugcucugcugagcucagagugcaaagguuggggcuggacag

SEQ ID NO: 54917 - RNA, 76 nt, Homo sapiens
cuggcauguguauucauguugaauagacaguucuauucaauagaacuguccauucagcaugaacaagauugaccag

SEQ ID NO: 54918 - RNA, 79 nt, Homo sapiens
cuguuuaaaucugccauucugaucuaaugaaucuacagucacuauuuagauuauuggcugauuugauccaccugugcag

SEQ ID NO: 54919 - RNA, 88 nt, Homo sapiens
cuguuuuucauuugcuugacugauuuaucuccauuuccuuauuuugagccuauggaguguaaauuaguucagccauugggaaaagcag

SEQ ID NO: 54920 - RNA, 66 nt, Homo sapiens
cuuaacagugguauugaugaccauuaauccuucaaccuaaaccugcucauuaaugcugccuuuaag

SEQ ID NO: 54921 - RNA, 57 nt, Homo sapiens
cuuacagauggauggcagcuggcucuucaccagaugcccaaguugucauuuuguaag

SEQ ID NO: 54922 - RNA, 90 nt, Homo sapiens
cuguggguagauacccaguggugagauugcuggaucaaaugguaguucuacuuuuaguucauuaaggaaucuccccacuuuuuuccauag

SEQ ID NO: 54923 - RNA, 95 nt, Homo sapiens
cuguuauuaauuaauugauugauuuugaggcagggucuuacucucauauauuuuuucuuggcugauauuauuuaauguaauugauugauugacag

SEQ ID NO: 54924 - RNA, 81 nt, Homo sapiens
cuguugaugagaauguaaguuaaugaaaucauuuauauauauguauuuuuuuagggacuugcuccuuauugccaccuacag

SEQ ID NO: 54925 - RNA, 70 nt, Homo sapiens
cuguugcccaggcuggagugcaguggugcaaucuugguucgcugcgaccuccaccucccggguucaacag

SEQ ID NO: 54926 - RNA, 68 nt, Homo sapiens
cuguugccuaggcuggagugcaguggcaugaucucggcucacugcaaccucugccucccagguucaag

SEQ ID NO: 54927 - RNA, 83 nt, Homo sapiens
cuguugcuuauuacauccauaggcucugcuucuacuaacguccuugaaccuuggagcagagccuauggagguauuaaggacag

SEQ ID NO: 54928 - RNA, 72 nt, Homo sapiens
cuguugcuuuggcaaugucauuuucaaucauacaggaguauguguuguugaucguaacauuguagagcacag

SEQ ID NO: 54929 - RNA, 79 nt, Homo sapiens
cuguuggcaauauuuacugaaguugaaaauaugcauguucucucaccaccaguucuacuuccaguuauauagccagcag

SEQ ID NO: 54930 - RNA, 79 nt, Homo sapiens
cugugcaaaaauaaguugcuguuggucaaaccauccgauuuaugguauuugauuauagcaugcuuaggaacuaacacag

SEQ ID NO: 54931 - RNA, 65 nt, Homo sapiens
cugugcuugagagaugacacagguaccucacugaguguuacuguagugguucuccagguggacag

SEQ ID NO: 54932 - RNA, 75 nt, Homo sapiens
cuguggacaacaggaguuuuguuagugcucuucagggucccggagaucauguacuagaacaccuuuccuccacag

SEQ ID NO: 54933 - RNA, 86 nt, Homo sapiens
cuguagccuuguaguauaguuugaagucagguagugugaugccuccagcuuuguucuuuuggcuuaagauugucuuggcaaugcgg

SEQ ID NO: 54934 - RNA, 68 nt, Homo sapiens
cuguagucucagacuuuugggcucaaagcauccuccaacaucagcuucucaaaguacugauauuacag

SEQ ID NO: 54935 - RNA, 68 nt, Homo sapiens
cuguagucucagcuacuugggaagcugaggugggaggaucacuucagcccaggagguugaggcugcag

SEQ ID NO: 54936 - RNA, 65 nt, Homo sapiens
cugucagacacugagcaaacgacuagcucgagcgaguucagucucaaccuuaguuucugccacag

SEQ ID NO: 54937 - RNA, 63 nt, Homo sapiens
cugucuuugggacuggaaggaguaaggguuuccuuccuuauagcacuagauuuuaaacgacag

SEQ ID NO: 54938 - RNA, 69 nt, Homo sapiens
cugugaacauuuuguauauauuauucugcaauuccauuaauagguaaaaugugcaaacauguucuauag

SEQ ID NO: 54939 - RNA, 62 nt, Homo sapiens
cugguguuugagaagcugaugucaggacaugauggagcuuggcugcagcauccgaggaccag

SEQ ID NO: 54940 - RNA, 73 nt, Homo sapiens
cuggucuggagagugauaaguaaauggagaaauaaucaguuuuacucuagaacuagaucaccucaacagucag

SEQ ID NO: 54941 - RNA, 98 nt, Homo sapiens
cuggugacauuaaaucagucuuucaucuggcgaaugugaagagugccuaauauguaggaggcauuguucuagguccuaggauguaagagaugaaccag

SEQ ID NO: 54942 - RNA, 60 nt, Homo sapiens
cugguucuuauugccuuauauauuuuuuugaauggaaugagaacugucaaugagagcuag

SEQ ID NO: 54943 - RNA, 59 nt, Homo sapiens
cugguuuguaaaguuccugagauuucaauaaugggcucucacaaaccaguauaggccag

SEQ ID NO: 54944 - RNA, 68 nt, Homo sapiens
cuguaaccuccaccuccuggguucaaaugauuauccugccucagccacccauguaggugggauuacag

SEQ ID NO: 54945 - RNA, 55 nt, Homo sapiens
cguuuugaucagugauggaccgcauauacaaugguggucccauaagauuauaaug

SEQ ID NO: 54946 - RNA, 74 nt, Homo sapiens
cguuuuuaugacugaguagcauuccauuauauuuauauuuauaauggaauaauacucagccauauaaaggaaug

SEQ ID NO: 54947 - RNA, 98 nt, Homo sapiens
cuaaacauaauuaaaugguagagcuuauuuucaaguuuugcuuauuuuuauauguaaagcuuggauuuaggcuaauaaaaaucaggaaauuuguuuag

SEQ ID NO: 54948 - RNA, 61 nt, Homo sapiens
cuaaacugucuugcaguuacaugugcauguguauauguuuaugugaguaagagaguuuuag

SEQ ID NO: 54949 - RNA, 56 nt, Homo sapiens
cuaagauggagucuugcucugucaccccuggcuggagugcaauggcaccaucuugg

SEQ ID NO: 54950 - RNA, 72 nt, Homo sapiens
cuaauuugguuauaguguaucuugaguaaaucaccucaaugagaauuuuagguuacauauaauccaaauuag

SEQ ID NO: 54951 - RNA, 65 nt, Homo sapiens
cuacaguaugaaaccuuuacucucuauacuaugcaugauauaauggaugagggguucguauguag

SEQ ID NO: 54952 - RNA, 72 nt, Homo sapiens
cuaccugugaagauguuucuuaauugacuuaaccaaaaucuuauugauuaauuuguauacaucuuuggguag

SEQ ID NO: 54953 - RNA, 57 nt, Homo sapiens
cuacgguuuguauaacuccucauguuccauuacaugugcagauguuacaaauuguag

SEQ ID NO: 54954 - RNA, 69 nt, Homo sapiens
cuacuguugugcgcgcuugggcuaucuucaaguccugccuauuucaaaugguccacgugaacauuguag

SEQ ID NO: 54955 - RNA, 60 nt, Homo sapiens
cuagacacugacguuccuccgagaguagaggcguggcucucaggggcaggaugugucugg

SEQ ID NO: 54956 - RNA, 130 nt, Homo sapiens
cucaaaauuucuuugacuacuugggcccuuuuguaguuccacacagauuuuaugauuuuuaaaauauuucuuugaggaaugucauuuguguuuugacagggauugcaucaaauguguagauucuuuuggg

SEQ ID NO: 54957 - RNA, 65 nt, Homo sapiens
cucacaaguuaguauugguuuugggaaguugcuuugcuuuugauguugauacuaccuucagugag

SEQ ID NO: 54958 - RNA, 65 nt, Homo sapiens
cucacaauucagacaugugugcauuagauuaacuaguaugaugacauugucacagucugagugag

SEQ ID NO: 54959 - RNA, 58 nt, Homo sapiens
cucacacugucuucauuacuguagcuuuguaauaggcuauaaaaucaggcagugugag

SEQ ID NO: 54960 - RNA, 80 nt, Homo sapiens
cucacaguugcacauggcuggggaggccucacaaucauggcagaaggcuaaaggcacuuccuacauggcggcugcaagag

SEQ ID NO: 54961 - RNA, 59 nt, Homo sapiens
cucaccucaggugaucuggcuaccucugccucccaaagugcuaggauuaccugggggag

SEQ ID NO: 54962 - RNA, 126 nt, Homo sapiens
cucacgucucaagauccaagcuucccaaaguaaagacucaugucccuuuuauaagggcuuacaacucuaagggguccaugugaaaaggucgugauacauugcacaagugggggcuaugugacugag

SEQ ID NO: 54963 - RNA, 55 nt, Homo sapiens
cucacuaggaaguaaaguuuguaagcccaaggccaauaugcuaauuuuuaguggg

SEQ ID NO: 54964 - RNA, 101 nt, Homo sapiens
cucagacuccagcaugcaucagaaucaccuggaggugaucacuuguuaaaaugcgcaucgcugggucccaccuccagaguuucucaugcuggaagucuggg

SEQ ID NO: 54965 - RNA, 82 nt, Homo sapiens
cucagaguguggcuucauguaauauuucacagcuuuccaugcagguucagaaggcugucauuugcaugaauccacuucugag

SEQ ID NO: 54966 - RNA, 74 nt, Homo sapiens
cucagccauuagaaguagagguagagugacuuccccagcugugugaccuugggaagucacucuaccucucugag

SEQ ID NO: 54967 - RNA, 130 nt, Homo sapiens
cucagccucucaaagugcugggauuacagguaugagacacugaauccggccugauggauuguuuuuaaaacugaaacucagcugggcaugguggcucacgccuguaaucccagcacuuugggaggcugag

SEQ ID NO: 54968 - RNA, 60 nt, Homo sapiens
cucagggacaguaucauuuaggagaauauguuuuuauugcccuaaauugcuucaccugag

SEQ ID NO: 54969 - RNA, 88 nt, Homo sapiens
cucagguauuucuuuauaacaaugcaagaauggccuaauacguaaaauuaguaccuaggaguggagcacuguuauaaagauuccugag

SEQ ID NO: 54970 - RNA, 76 nt, Homo sapiens
cucaucacaaauaucaagguacauacuaucaacgugacuuaccacugcugauguugaccuugaucaccugggugag

SEQ ID NO: 54971 - RNA, 62 nt, Homo sapiens
cucaucauaacucugaaaacucuacuuccaaauugcacucugaguuucaggguggacaugag

SEQ ID NO: 54972 - RNA, 60 nt, Homo sapiens
cucaugcacugaguccaccucuggacucugugggggccagaggaccgguuuagucaugag

SEQ ID NO: 54973 - RNA, 58 nt, Homo sapiens
cucauuugggagauaauacaugcccacagcacaggguauuguauguaaaccaaaugag

SEQ ID NO: 54974 - RNA, 78 nt, Homo sapiens
cucccucuggguucccugaagauacagaguuugggggugagaggcccgccagacugcacuuuuuaggcuaggcgggag

SEQ ID NO: 54975 - RNA, 129 nt, Homo sapiens
cuccugaucucaggugaucagccugccucggccucccaaagugcugggauuaggccaggcgcaguggcucaugccuguaaucccaguacuuugggaggccgaggcgggcagaucaccugaggucaggag

SEQ ID NO: 54976 - RNA, 86 nt, Homo sapiens
cuccugcugggacccgggaggacaaauaggugcagccccccuagaaugguugagccaaggauugucuuuccugguuccugaaggag

SEQ ID NO: 54977 - RNA, 61 nt, Homo sapiens
cuccuggcuuggaggaaugugagggcuuugcucaaagccccaagcacuucaggcucagggg

SEQ ID NO: 54978 - RNA, 58 nt, Homo sapiens
cuagcaguauaugagagcuauuguuacucuaaaccauaacaacucuugauacuguuag

SEQ ID NO: 54979 - RNA, 95 nt, Homo sapiens
cuagcuuuguauauauacuucauguuagugaaauccugcaguacuagucuguuuguaacuggcuuauuucacuuagcauaaguccucaagguuag

SEQ ID NO: 54980 - RNA, 110 nt, Homo sapiens
cuaguuguguuugagugccauuagaauguaaauuccaagggcaggacauuucugccuguuuuguuucugcuuuuguuuguuauauucccagcaccuaaaaccacaccuag

SEQ ID NO: 54981 - RNA, 66 nt, Homo sapiens
cuauaauacugaaaguauuuucaaaucuaggaugaccaggauagaggaauuguucaguguucauag

SEQ ID NO: 54982 - RNA, 80 nt, Homo sapiens
cuauaaucccaguguucuggaaggcugaguuaggagaaucacuugaggccaggauuucaagaacacccugggcaacauag

SEQ ID NO: 54983 - RNA, 129 nt, Homo sapiens
cuauauagacguuguacaugccggauuuauuuugaggcgaacgcaaucauuuugaaaugccuaguuuucaaaguaaaaauguguucacguuacaaaaccacuguagcaagacauuucuauuaaaaauag

SEQ ID NO: 54984 - RNA, 79 nt, Homo sapiens
cuauauuuauacuacuauaaagagguaguuguagcaaucugguccuaaauuauugaucucuauaguaguauagagguag

SEQ ID NO: 54985 - RNA, 74 nt, Homo sapiens
cuaucguaaugcacauauauuuccuuauucugccauaauaaguagaaucaacaggaugugcauuguaaagguag

SEQ ID NO: 54986 - RNA, 66 nt, Homo sapiens
cuaugagucugcagaucuauuaaggggcccaccaaguacaccucuauggaauuccagacuauauag

SEQ ID NO: 54987 - RNA, 99 nt, Homo sapiens
cuaugcugugcuggacuucugaucuacagaacugugaacuaaaaaagucgauguuguuuuaaagcacggaguuuguggcaguuuuuuacauagcaauag

SEQ ID NO: 54988 - RNA, 76 nt, Homo sapiens
cuauggaugccuuucuaggaauacacuuuccgggguuccuuuuuucccugagaugugaauuucagagcuuccaaag

SEQ ID NO: 54989 - RNA, 116 nt, Homo sapiens
cuaugugauagcuuuaagguuggugcaaaagugauugcgguuuuugccauuacuuucgauggcaaaaccugcaauuacuuuugcagcaacuuaauaaauaacaaagaaacauguag

SEQ ID NO: 54990 - RNA, 64 nt, Homo sapiens
cuccacuccuuucaugaagucuuccucacaagaguagaauaauauuuucaauguaaggauggag

SEQ ID NO: 54991 - RNA, 76 nt, Homo sapiens
cuccagcaucuagcaauuguccucuucccucacuguguuaggucucggggaggucauuguucaaugcuguuccgag

SEQ ID NO: 54992 - RNA, 65 nt, Homo sapiens
cuccaggacacugauguaugcugugggcuggugcagcccagggcacagcagucaguuccauggag

SEQ ID NO: 54993 - RNA, 62 nt, Homo sapiens
cuccagggauucagauaucaauauaccacaguucguucuuucuggaguuugaguucuuggag

SEQ ID NO: 54994 - RNA, 55 nt, Homo sapiens
cucccaggcuacaggaucuuugacugagcucucaguggauguuguggccugggag

SEQ ID NO: 54995 - RNA, 83 nt, Homo sapiens
cucccaugacccaggauuccaguuugugagaagcugugccaugugcaaugguuaacauuccagauuggagccugacacgggag

SEQ ID NO: 54996 - RNA, 67 nt, Homo sapiens
cgucaguuuacuguugccauggcaacacugggacguuacagucccuuuccauggcaaugaucugaug

SEQ ID NO: 54997 - RNA, 72 nt, Homo sapiens
cgugaauuaugguaucucauuuuggauuugaaauguauuucugaaucacagauuaugaguaucuguuucaug

SEQ ID NO: 54998 - RNA, 85 nt, Homo sapiens
cguguuagacacggugggcucguucguguuagacacgguggacucguucguguuagacacggugggcucguucguguuagacacg

SEQ ID NO: 54999 - RNA, 77 nt, Homo sapiens
cguuagccuuccucugauuuacauucaacucugaucccugggccuuagguuugacauggagguggaggaagauagcg

SEQ ID NO: 55000 - RNA, 77 nt, Homo sapiens
cccuuagcacagugcgugguacauaauuagugcucaauaaauguuagcucuuguuaguauuagcaguugugcagggg

SEQ ID NO: 55001 - RNA, 66 nt, Homo sapiens
ccgauuuaugucucugacuugauuuauggaaauaauacuaguuguugcaucagcaggcauaauugg

SEQ ID NO: 55002 - RNA, 56 nt, Homo sapiens
cccgggagguggaaguugcagugagcccagauugugccauugcacaccagccuggg

SEQ ID NO: 55003 - RNA, 56 nt, Homo sapiens
cccgggagguggagguugcaaugagccaaaaucaugccauugcacaccagccuggg

SEQ ID NO: 55004 - RNA, 67 nt, Homo sapiens
cccgaguaccugagauuacaggugcuggccacaccuggcuaauuuuuguaguuuuaguagagauggg

SEQ ID NO: 55005 - RNA, 61 nt, Homo sapiens
cccucuacagggaagcgcuuucuguugucugaaagaaaagaaagugcuuccuuuuagaggg

SEQ ID NO: 55006 - RNA, 104 nt, Homo sapiens
cccucugggcgacuccggcucaucgauuccggcccagaggagcgcccccgggcgccgaggaugggcggagacgugcagccgccccugagaggucgcccagaggg

SEQ ID NO: 55007 - RNA, 63 nt, Homo sapiens
cccucuucuacauucuugagcugaccuagaauuaggguucccccuuuggcaaugagaacaggg

SEQ ID NO: 55008 - RNA, 69 nt, Homo sapiens
cccugauuuaaaguguaugggaggguaugcauagguuauaugcaaaugcuacaccauuuuguauuaggg

SEQ ID NO: 55009 - RNA, 59 nt, Homo sapiens
cccucaccaagggucccaaggaauaccaaacggucauuccuuaggcccuuugguuaggg

SEQ ID NO: 55010 - RNA, 69 nt, Homo sapiens
cccucauuguaacacaugcugcucucuggugggcaauguugaaaaccagggagcuggcauguguggggg

SEQ ID NO: 55011 - RNA, 88 nt, Homo sapiens
cccuuuagugagguuggaaaaguuuucuuggacaauauucugagauauguuuuccaagaugcuuacuuucuccgcaucucuuccgggg

SEQ ID NO: 55012 - RNA, 97 nt, Homo sapiens
cccuuuauuugaaagaacuagaauguuuucauuauccuaacuguauccugacagauaucagagguauugcaaaagccuagauuccaaguacaaaggg

SEQ ID NO: 55013 - RNA, 109 nt, Homo sapiens
cccuuugcauuuacauuuuucauauuguccuuuaaugugcagugaucauugauuguccauugauacugugcauuagaggcuaucuggaaauuguuguauguagauaggg

SEQ ID NO: 55014 - RNA, 74 nt, Homo sapiens
cccuuuuaugacuauugcacuuuccugguacagaugagggcuucuacuaggaagguggcagugaggagggaggg

SEQ ID NO: 55015 - RNA, 78 nt, Homo sapiens
ccgguaugaggaaugaucauauguuucagguuaaauguagcaagcaguuugacuuuuagaauaugaguuuccagccgg

SEQ ID NO: 55016 - RNA, 64 nt, Homo sapiens
ccgggcacagaguugugagggaacgugggauauccaaagguucuaaguaauuuugcaugccugg

SEQ ID NO: 55017 - RNA, 66 nt, Homo sapiens
ccggcagcaguguuguggagucuauugugagggacaaacucucagaaccuccuagcaguguucugg

SEQ ID NO: 55018 - RNA, 76 nt, Homo sapiens
ccugacuccuauggaaaggggcaauaagaagcauaaauucuugucauagguauugcacuuuuccauaggagucagg

SEQ ID NO: 55019 - RNA, 66 nt, Homo sapiens
ccugacucugauuucgcugcauaacucccaggggcauccugcucugaugucaggaagggagucagg

SEQ ID NO: 55020 - RNA, 84 nt, Homo sapiens
ccugacuuuuuaaugauugccauucuaacuggugugagaugguaucucacugugguuuugaugugcauuucucugauggccagg

SEQ ID NO: 55021 - RNA, 73 nt, Homo sapiens
ccugagaacugagauaagugauauucuuuucuauuuuguaaauucaaguaguauugauuucuuagauuucggg

SEQ ID NO: 55022 - RNA, 67 nt, Homo sapiens
ccugaggaaauuguaaugacuucacuugaggcagcugccuuggaagacaaugcugauucucuucagg

SEQ ID NO: 55023 - RNA, 64 nt, Homo sapiens
ccuaccucuuuguaauaagaauugaggcaaauuugucaucaaaugcucuuugcagagagguagg

SEQ ID NO: 55024 - RNA, 129 nt, Homo sapiens
ccugauuuauuuauucaacaaguauguaccuucccaggcauuagucaaguguacugugaaugaaaaagacaaaaaucccuauuauccagagcuuacuuuuuagcuaggggagguagauaauaaaugagg

SEQ ID NO: 55025 - RNA, 67 nt, Homo sapiens
ccuggaucaugugucucagcccagaccuauuugugugucuuaacguaaagcugugacugaugcuagg

SEQ ID NO: 55026 - RNA, 79 nt, Homo sapiens
ccuggguguauucauuggccugaucaacacaaugaccaaaucuggucacagugcaggaucaguuaaugacuguccuagg

SEQ ID NO: 55027 - RNA, 112 nt, Homo sapiens
ccuggugucugagggguuuuguccacagcuuguccugcuacauuucuugguucucugacugggaagcgaggugauuagcagacagucaaggcagccccuuagguggcucagg

SEQ ID NO: 55028 - RNA, 69 nt, Homo sapiens
ccugguuaucacuguuguuuguuuaaggcuuuaggccucuacaaugagcaagugguaaaauaaaccagg

SEQ ID NO: 55029 - RNA, 125 nt, Homo sapiens
ccugguucaugucauucuccuuccucagccucccaguuagcugagacuacaguaggugccagccacgcugccuggcuaauuuuuuguauucuuaguagggacgagguuucacuguguuugccagg

SEQ ID NO: 55030 - RNA, 63 nt, Homo sapiens
ccuaaugacauugaugcucuggcugggagggcucagucccggagggggugucaaguugauagg

SEQ ID NO: 55031 - RNA, 121 nt, Homo sapiens
ccuagaccuaaagggaacuuugaaagaaaggagacugaguucauuuacaaaggguuaaaagagugauauuuaagcugugucugaagauuuuuuuuaaagauucuacaagaucuuggcuagg

SEQ ID NO: 55032 - RNA, 66 nt, Homo sapiens
ccuagcuggaguuuuuguuauaggauauuguguggcagagccugggacaugagcucgagaccuggg

SEQ ID NO: 55033 - RNA, 129 nt, Homo sapiens
ccuaggcuuccuccaacagauuuugccauuugacucugaugaguguuccuuuguccagucuaagacaauaucuacucaauugcagucaccuggccagcaaaaaucuccuagccgaaguaucaccuuuug

SEQ ID NO: 55034 - RNA, 62 nt, Homo sapiens
ccuauuagacacaacaacauauaaguacagauuaagauguuaagaugugcuguguuguuagg

SEQ ID NO: 55035 - RNA, 74 nt, Homo sapiens
ccuauugcauccauucuagacucaucuaaaccacccauugcuggucaagagaggucuaaaaugguugugguagg

SEQ ID NO: 55036 - RNA, 70 nt, Homo sapiens
ccuauuucaugagagaccuacagcuuauuaccuugcuguguggaaugaaaacucucucacaaagaauagg

SEQ ID NO: 55037 - RNA, 55 nt, Homo sapiens
ccucaaagucaagggaaagcaggucaaaugauuuuguuuagcgcugacauugagg

SEQ ID NO: 55038 - RNA, 61 nt, Homo sapiens
ccucagauguguaucuguacauuauuuuucuuaaugauauugaacacuuucauaugugagg

SEQ ID NO: 55039 - RNA, 129 nt, Homo sapiens
ccuccacuccccuuuccagagggggccaugguuaacaguguguguguucaccuagaccguuuaugcaucuguagacacacacacagugaagugugguuuucgucguuuugguggggagguugguuucug

SEQ ID NO: 55040 - RNA, 81 nt, Homo sapiens
ccuccgaugcugcuuugguagaaaucuuugguuuggagucagacacuuuggugccaagacagguuuuuauaaguuaggagg

SEQ ID NO: 55041 - RNA, 62 nt, Homo sapiens
ccucucagguccuuacugugcucccuccgcagaugagaaggagacgccagggccuggggagg

SEQ ID NO: 55042 - RNA, 56 nt, Homo sapiens
ccucucuugaaagacuccuuuggugaccagugggucacaguccuguuuaggagagg

SEQ ID NO: 55043 - RNA, 89 nt, Homo sapiens
ccucugcugagaugauguucaggcucaugguggcuucaggauuaucauaagcacccuuugucuggacauguccugaaacucagcagagg

SEQ ID NO: 55044 - RNA, 66 nt, Homo sapiens
ccucugugcacauuguuuaugucuguuggacaauuuuccagcaauaccccauguugcacaugaagg

SEQ ID NO: 55045 - RNA, 119 nt, Homo sapiens
ccucuguggaaaugaguaaugcugccuuaccuacuuaccacaugucaucuuguauccuuguuaagaguagggcccauggaaguaaucaugagguagcacauaccauauuaccacugagg

SEQ ID NO: 55046 - RNA, 57 nt, Homo sapiens
ccuuucuagauagaugaaacccauauggagaggaaauagugacaucauuuagaaagg

SEQ ID NO: 55047 - RNA, 63 nt, Homo sapiens
ccuuuuaaaauauugguggccaggugugguggcuuacgccuguaauaucagcauuuugggagg

SEQ ID NO: 55048 - RNA, 62 nt, Homo sapiens
ccuucauacaaagaaaaaucaggugagcgaucacaguaccugguuuuaacauuguauuaagg

SEQ ID NO: 55049 - RNA, 63 nt, Homo sapiens
ccuucauagucacauucgaugucuccuacaaggccacccugggagacaggaugcuuaugaggg

SEQ ID NO: 55050 - RNA, 68 nt, Homo sapiens
cgaaacuacuuugugauuugugcauucaacucacagaguugaaccauucuuuugauagagcaguuuug

SEQ ID NO: 55051 - RNA, 68 nt, Homo sapiens
ccuucccacccgcccagguguggccgggacagcaccgcaguuguggcgccccugggugggcaggaggg

SEQ ID NO: 55052 - RNA, 92 nt, Homo sapiens
ccuguaguacacagaguaggcuagguguguuuucagaaguccuagaugcuuuggaauguacucuagccuaugcuuugguuugguaaugcagg

SEQ ID NO: 55053 - RNA, 60 nt, Homo sapiens
ccugucacuguggagaagaaaguggggcugauccuccccuugacuccagggugacccagg

SEQ ID NO: 55054 - RNA, 88 nt, Homo sapiens
ccugugaaaagcagaagucacagaugucucucagaagacgugaaauccaccagagagugacacugucuucugcucuuaaauccacagg

SEQ ID NO: 55055 - RNA, 58 nt, Homo sapiens
ccugugaugaagaguccaagaacagccugagauaaggaugucauucuucuuucacagg

SEQ ID NO: 55056 - RNA, 76 nt, Homo sapiens
ccuuacuaguguuggauuuuaacaaacuaggugagaagaagccucagcuaguugauaaaauucauuuguaaugagg

SEQ ID NO: 55057 - RNA, 71 nt, Homo sapiens
ccuucucugcuucaggguacuuguggccaaaguuagauguuuaacuaaccacuuuacaccuggugagaagg

SEQ ID NO: 55058 - RNA, 96 nt, Homo sapiens
ccuuggaaccuccuaugugcugcaucuuuggauggaaauuggagucccagagacaaaugaggcuccacccugcuuccagaagcucagaguccaggg

SEQ ID NO: 55059 - RNA, 84 nt, Homo sapiens
ccuuggccucccaaagugcugagauuguaggcaugagccacuugcccagccugcacagaacuuuuaauaauggaagcuuuaagg

SEQ ID NO: 55060 - RNA, 67 nt, Homo sapiens
ccuuggucucaucaagagcagcuuuguaguucucugagcuguggggucucuaggcugagaacugagg

SEQ ID NO: 55061 - RNA, 95 nt, Homo sapiens
ccuuguacuugugugcuguagcuguaauuuuauuugccauuuuauauaacaaaugcagagaaaucuaaaauauggagaugaacaacaggauaagg

SEQ ID NO: 55062 - RNA, 73 nt, Homo sapiens
cgaagcuggauuuaguguggagcaaaauuucauauacaugcuugcacugcugcacacuauguuuacuguuuug

SEQ ID NO: 55063 - RNA, 77 nt, Homo sapiens
cgagcugugaaacccuaagaagaagggagcugaaccagugauugugaaacagcaucauucaucugggguaauacucg

SEQ ID NO: 55064 - RNA, 63 nt, Homo sapiens
cgauaaguauuuggacuuuacugugaguaagaggagccacugagaguguuaaauacuuaauug

SEQ ID NO: 55065 - RNA, 56 nt, Homo sapiens
cgccuauuacuuuuuuuccaauuucaauuaggaacauggaaguaagaauauaggug

SEQ ID NO: 55066 - RNA, 71 nt, Homo sapiens
cgcucucuugccuaggcuggagugcaguggugcgaucucggcucacugcaaucuccucccagguucaagcg

SEQ ID NO: 55067 - RNA, 63 nt, Homo sapiens
cgcugcuuuuaagaacuguaacacucacugcaagggucuguggguucauucuugaagucagug

SEQ ID NO: 55068 - RNA, 67 nt, Homo sapiens
cggugaggcaaugaggcggaccagcagguucccggggaucucugcagccccguugccauaacaaccg

SEQ ID NO: 55069 - RNA, 59 nt, Homo sapiens
cggggacacacuggcagcuccuaccaauuagugaccuaacccugccagugugcucuccg

SEQ ID NO: 55070 - RNA, 127 nt, Homo sapiens
cgggaccgccuaacuuagaaucucugaugcuguaggcuaggcgucaguauuuuaaauuuucacacucauaagguugagaucaacugagucagagcauuagcauuagauuaugagaacccgguaucug

SEQ ID NO: 55071 - RNA, 122 nt, Homo sapiens
gcagaaauauauccuggcaucaucacuuucaauagcuggauguauguuaagugaaucauugccaccccagagguggauuuccuucuauauauauuuuaaugaacucgagucaggauuuuugc

SEQ ID NO: 55072 - RNA, 64 nt, Homo sapiens
gcacugcuuaguaaugggaccgguucugagaaauguguuuucagaccauuucauuacagacugc

SEQ ID NO: 55073 - RNA, 62 nt, Homo sapiens
gcagaggcaguugaaugaugcguuugguggguggcagcaaaugcauaucaagauugcccugu

SEQ ID NO: 55074 - RNA, 67 nt, Homo sapiens
gcacuugcauucauugaaaacacacagauagaccuucacaucucacagaguuucagaguggaagugu

SEQ ID NO: 55075 - RNA, 129 nt, Homo sapiens
gcagaguguaauucccagcuccuugacuuagacuuggccauaugacuugcuuuggccaaugguauguggccgaaguaaaagugugcuaguucugagccacaucauucauuucuacuugcugucuugugc

SEQ ID NO: 55076 - RNA, 67 nt, Homo sapiens
gcaaggauagcagccauucuuuuuauuuguuaaaugucuuuuaagugggagaauaucugcuaugugc

SEQ ID NO: 55077 - RNA, 76 nt, Homo sapiens
gcaccuagaacaaugccuggcacauaguagacacccaauaaauacuuacugacaugaucaggcauguucagggugu

SEQ ID NO: 55078 - RNA, 71 nt, Homo sapiens
gcaggauuuccuucuuuuguaaggcugaauauugcauuuaaauauauaccacgcagaaggagaaauacugc

SEQ ID NO: 55079 - RNA, 63 nt, Homo sapiens
gcaggcaccaugagcaucauggguacaaaaggaguccaauuucaagugcaucguugugucugc

SEQ ID NO: 55080 - RNA, 78 nt, Homo sapiens
gcagccauuguucuauccaaauuggguaucuguuaaccauuugaaagguauagguucuggaggcuuaacaauggcugc

SEQ ID NO: 55081 - RNA, 92 nt, Homo sapiens
gcaggagaauugcuggaaccugggagguggaggcugcagugagccgagaucacuccauugcacuccagcccaggugacaacagugagacugc

SEQ ID NO: 55082 - RNA, 58 nt, Homo sapiens
gcaggaguaaauuugcugaacucaaggcacugccuagagaaguaaauauuaucucugu

SEQ ID NO: 55083 - RNA, 78 nt, Homo sapiens
gcagaugcucaguggguguaauuuucucucucuuccuauuugugagucgacaugaaaacugcuucucuggguuucugc

SEQ ID NO: 55084 - RNA, 107 nt, Homo sapiens
gcagaugucuacaacuccaaggacacaugcauuggucuauuaugugaaaaaguaauccauuucuauuacauuaagccaauggauucuugaguuugauuuauuacugc

SEQ ID NO: 55085 - RNA, 64 nt, Homo sapiens
gcagauuaaguggauuuaaaugucugguccauagcaaugucagcaccuuuccuccacuaucugc

SEQ ID NO: 55086 - RNA, 57 nt, Homo sapiens
gcagccugggguuaagggagguauggcacaaauauucccuuagcugccucagccugc

SEQ ID NO: 55087 - RNA, 66 nt, Homo sapiens
gaugcuacucauuucaccuauauuauugaauuucaucugugaggacuccgugagguggguaguauc

SEQ ID NO: 55088 - RNA, 64 nt, Homo sapiens
gaugcugagagauuggagacuaguuucauucuucuguauguggauauccaguuuucccagcauc

SEQ ID NO: 55089 - RNA, 57 nt, Homo sapiens
gaugaggcuagagacauguguagggagcauaccauagacagauuuguaggucuuauu

SEQ ID NO: 55090 - RNA, 65 nt, Homo sapiens
gauggcacuaagccauguaggaaggauccaucuccaugauccaauaccuccaacuaagucccauc

SEQ ID NO: 55091 - RNA, 126 nt, Homo sapiens
gaugguauuuucucaugacuaccuccagcaaagacuuauggaaggcuugugauaccucagcuuggauuacaugucuauccaugaacaauuauuguggacaaggacauagauuuucugaguaccauc

SEQ ID NO: 55092 - RNA, 75 nt, Homo sapiens
gauguaggauaacagcauuauugcauacguuaauuauucauugaacuacuuaugucuaugaugcugacauacauc

SEQ ID NO: 55093 - RNA, 67 nt, Homo sapiens
gauguauuaucuuugugguaucguguugaauucauuuagcugguauuuugucaaggauauuuacauc

SEQ ID NO: 55094 - RNA, 56 nt, Homo sapiens
gaugugcaaauuuccaaacucuuaaaacagaauaauuaaggggugaauugcacauu

SEQ ID NO: 55095 - RNA, 85 nt, Homo sapiens
gauguguuugacauaguuucugaaauagaccacagcauaugccacuugguuucuauuuuaagauagguauguugacagaggcauu

SEQ ID NO: 55096 - RNA, 95 nt, Homo sapiens
gauguugagaauuuuuucauaagcuuuuggacauuuggauuuucucauuugugaaguuucuguucaaauuguuugugaaguuccugcuugacauu

SEQ ID NO: 55097 - RNA, 55 nt, Homo sapiens
gcaaugcugucugugcacagaucaugaggaaggucuguggguuuugcagaguugc

SEQ ID NO: 55098 - RNA, 86 nt, Homo sapiens
gcaauguaguccacauccaucagacggcaggcguugaguaccagagaggcauaccaugucuauaaucugaggacauccugcauugc

SEQ ID NO: 55099 - RNA, 58 nt, Homo sapiens
gcaacacuggcuuugugaauacaucuucuaaagggaauuauucacucuccagucuugc

SEQ ID NO: 55100 - RNA, 114 nt, Homo sapiens
gcaaaggucuaacagggguauugauaucagaguggguuuuaaaaguguauuaacuauaaucuuacuuuuagccuauuugauucuacuuauuucagaacuauuaaugacguuugu

SEQ ID NO: 55101 - RNA, 60 nt, Homo sapiens
gauuccuuuuaaugguuaaaguugcaggucugaaaauauuuugaucauuaaaagugaauc

SEQ ID NO: 55102 - RNA, 82 nt, Homo sapiens
gauuaauuuguugagaaguaguauguuuauagcauugaguccuacgauucauaauauauauggcauauauuucaguuuaguc

SEQ ID NO: 55103 - RNA, 78 nt, Homo sapiens
gauuauuuuuaagggagacuuuacaagcauuaacaacuuguuugacuguuuuuguaaaguucucucccgaaaacaauc

SEQ ID NO: 55104 - RNA, 58 nt, Homo sapiens
gauuccauugcgaauuuucagaucaacuuuucuaccucugaaauaguccauugggauu

SEQ ID NO: 55105 - RNA, 80 nt, Homo sapiens
gauugcugagcugacuuugauguugguguuuaaugauaaacagauuucagauaacacggcccgcagagcaagcuguaauu

SEQ ID NO: 55106 - RNA, 58 nt, Homo sapiens
gauucuuggugauuuuaggggggaagacuccguaugaguuccuuaguuauagagaguc

SEQ ID NO: 55107 - RNA, 91 nt, Homo sapiens
gauugacucuuucaugaaagauuucucuguagcauaugaugcuguuugacagcauauuacaguagaaugucuuucaaaauugggguuaauc

SEQ ID NO: 55108 - RNA, 73 nt, Homo sapiens
gauugagagaaaaggcagcuguuauauacugaguauauauuauacucuuauucaucuguuuuuucuuaagauu

SEQ ID NO: 55109 - RNA, 67 nt, Homo sapiens
gcaaacuuuuuacucaaugauuccucugauaacaaguuaugggagaaccauuuggagaaaaaguugc

SEQ ID NO: 55110 - RNA, 85 nt, Homo sapiens
gauuuugaaagacuuucugcuguggauaaaaugcucucaaacagcaucauaugcuacagagaaaucuuucaugaaaggaagaguc

SEQ ID NO: 55111 - RNA, 72 nt, Homo sapiens
gauuuugucccucucaccaacggggaagaaugguugguuuuauuggguccugcuaagagagggaauaaaauu

SEQ ID NO: 55112 - RNA, 81 nt, Homo sapiens
gauuuuucaucugguuuagcugguuauuauauaugacaaaaagagaucacaaugugauaguuggcuaaagcagucugaguc

SEQ ID NO: 55113 - RNA, 87 nt, Homo sapiens
gauaaacaggaaugcuuuuacacuguugaugggaguguaaauuaguucaaccauugcagaagacaguguggcgauuccucaagaauc

SEQ ID NO: 55114 - RNA, 64 nt, Homo sapiens
gauaaagauagcaauagggacaaaaaguaaaauaaucucuuguguuauuauugcuauuauuauu

SEQ ID NO: 55115 - RNA, 62 nt, Homo sapiens
gauaaaguauuggguacuaugcacaccugggugacgggaucaguuguacuccaaaccuuauc

SEQ ID NO: 55116 - RNA, 67 nt, Homo sapiens
gauaaaucuuaucuuuguuacuuguuuauggcuggaagcggaaauaagucacacagauuaauuuauu

SEQ ID NO: 55117 - RNA, 68 nt, Homo sapiens
gauaaaugcuugaguggaugguaucccauucuccauaaugugauuauuaugcacugcaugccuguauc

SEQ ID NO: 55118 - RNA, 103 nt, Homo sapiens
gauaaggcuuugccuuaagggaauguuguggcugguuggauguuuuauccagaccacuaaaacuuucuccauaucaccaauaaggcugcuuugcuuucuuauc

SEQ ID NO: 55119 - RNA, 59 nt, Homo sapiens
gauagcagaccaccucucccacugggagcuccaucccagggugguuugaaacuguuguc

SEQ ID NO: 55120 - RNA, 70 nt, Homo sapiens
gagugguagagguagacuuccuugucuuauucuaguucuuugagaaaagguuuucagcuuuuccccauuc

SEQ ID NO: 55121 - RNA, 84 nt, Homo sapiens
gaguuaauaggugcagcacaccaacauggcacauguuuacauauggaacaaaccugcauguugugcacauguacccuaaaacuu

SEQ ID NO: 55122 - RNA, 82 nt, Homo sapiens
gaguuaaugggugcagcacaccaacauggcacguuuacauauguaacaaaccugcacguugugcacauguacccuaaaacuu

SEQ ID NO: 55123 - RNA, 104 nt, Homo sapiens
gaguauauacugcaugacuccauuuaucugaaauuuuauaauagucuaaacuaaucuaggaugauaggaaucagaaaagugguugucugugaggugugugauuc

SEQ ID NO: 55124 - RNA, 99 nt, Homo sapiens
gaguuucauacauguuguugugcauaucagagguuugcugacuuuuauuacuguguaguguuccuuuguguggacaccucacaauuuguuuauguauuc

SEQ ID NO: 55125 - RNA, 91 nt, Homo sapiens
gauaggauagaugguucugaguggcuuucaacacugacuacuauucucuuuuagccagcagugaguagcuuacucagaauuguccccuauc

SEQ ID NO: 55126 - RNA, 67 nt, Homo sapiens
gauaguggaguguaaagcgucuuuuucagacaguuuucugcaggaguggcuauuaagcugcaguguu

SEQ ID NO: 55127 - RNA, 101 nt, Homo sapiens
gauauauaaauauauguagaaaaagucuagaggaucaugugugguuuucucuaaguagaggcauuauaaaugauugucacuuuauauacauacuuuauauc

SEQ ID NO: 55128 - RNA, 63 nt, Homo sapiens
gauauggucaaagucacaaucucacuuggcugaacucucaagcugugugacauugagcauguc

SEQ ID NO: 55129 - RNA, 70 nt, Homo sapiens
gauauuccuauccuuaagucuucucaacuugaauucacguguuacugaaagacugaagaauaggcauguc

SEQ ID NO: 55130 - RNA, 108 nt, Homo sapiens
gauauuucacauaaauggaaucauacguauguaguucuuuugugacuggcuucuuccgcuuagccagauacagccacauaauguaugauuccauuuuuaugaaauguc

SEQ ID NO: 55131 - RNA, 79 nt, Homo sapiens
gaucagaguagcugucguuuuuuccuuuacugcagaauuauuauuuuaaguaaaugaaagguugauuuauaucugcauu

SEQ ID NO: 55132 - RNA, 56 nt, Homo sapiens
gaugaagugcccucuagugacccaacuaagugguggucacuggagcucauuugauu

SEQ ID NO: 55133 - RNA, 101 nt, Homo sapiens
gaucuggaaaauagcaggaagauaagagggaggugccucagucccgugggcaguuggugacucaggcaccuuccucuuaucugccugugggcacccagguc

SEQ ID NO: 55134 - RNA, 58 nt, Homo sapiens
gaucuuggagugcuugucaguggaagcuugugucucuugugacaugaaacccaagauc

SEQ ID NO: 55135 - RNA, 71 nt, Homo sapiens
gaugacauugaaaagcaaguggacuuaaauugcauaaucagaacuuauauucauagcuuuuuggucucauc

SEQ ID NO: 55136 - RNA, 73 nt, Homo sapiens
gaugagaauugcauugaauuuguagcuugcuuuuggcaguauggucauuuucacaaugucgauucuacccauc

SEQ ID NO: 55137 - RNA, 56 nt, Homo sapiens
gaugagcuaguguaggguacugaucuaauuuguuaggcuuaagucaccugcucauc

SEQ ID NO: 55138 - RNA, 108 nt, Homo sapiens
gaucccuucccagugaguguagguagaacaugugaaugugaucggauagucacuucugugauuauaaugcauuauaugggacuccacucuaacacauuaggagggauu

SEQ ID NO: 55139 - RNA, 130 nt, Homo sapiens
gaucucauuuauccauuuuugccuuggcugcuugugcuuuggggguauuauucaagaaaucuuugcccagaucaauuuccuggagaguuuucccaaaguucuucuucuaguaguuucaugguuugagguc

SEQ ID NO: 55140 - RNA, 60 nt, Homo sapiens
gagcuagguuuugaauccagaccauauacucauggccauuaggacuucaaacaucagcuc

SEQ ID NO: 55141 - RNA, 79 nt, Homo sapiens
gagcaggaacucagugccagaaugauacuguuaacgaaagaucucaccaaucuuucucuucaugucguuuuuccuguuc

SEQ ID NO: 55142 - RNA, 70 nt, Homo sapiens
gagcaucaugauuuccaguuauuauaccucuuaaaacaaguuuaaggaucauggcugggcgugguggcuc

SEQ ID NO: 55143 - RNA, 128 nt, Homo sapiens
gagcccucacuaauauagcaauauaugugucauuugucucacuaguaaggcuguuuaguagucaaaacuguagaaaauugaauauacacuuacuguauaaaaaugauaugcuugguuagugauaguuu

SEQ ID NO: 55144 - RNA, 70 nt, Homo sapiens
gagcccugaaagcuacagucuccuaggacccugaaggcuccuaaaccuuugagcuuuugucagaggguuu

SEQ ID NO: 55145 - RNA, 71 nt, Homo sapiens
gagcccugggauuguucuccugcaacuagauguucccaucugguggugaugagagacaguaacaaauccuu

SEQ ID NO: 55146 - RNA, 56 nt, Homo sapiens
gagccuccuccuggucccuauuauaaaagaacaaaguggucaccuucaggagguuc

SEQ ID NO: 55147 - RNA, 65 nt, Homo sapiens
gagcucaggaguggcuuuggcugcaucuuucucauagugaugaauugucagucacugccuggcuu

SEQ ID NO: 55148 - RNA, 99 nt, Homo sapiens
gagcugauagcacauaguguagacaagugaauacaggauucucuggguuauauuuccagaagucuggaggucauuuggauauuugugggcccuuggcuu

SEQ ID NO: 55149 - RNA, 59 nt, Homo sapiens
gagcugcaauguuuaguauaauauauguacggcauauguugcuggaguaguugcagcuu

SEQ ID NO: 55150 - RNA, 105 nt, Homo sapiens
gaggaaaagaaguucaacaucaagguauuggcagaauugguuucuucuaaggccucucuggcuuggagauggccauuuucuuguaucuucaugugaucuuuccuc

SEQ ID NO: 55151 - RNA, 78 nt, Homo sapiens
gaggaaccuucauacuguuuccauuaugguucugccaauuuacauuuacauuucugccaacaguguguaaguuuccuu

SEQ ID NO: 55152 - RNA, 83 nt, Homo sapiens
gaggaauuagcaucagauuccauauucuauauagcagagauuuauaggaugaugggauuugagguuuuaaaucacgaguucuc

SEQ ID NO: 55153 - RNA, 57 nt, Homo sapiens
gaggagaaugcugauaauuggugaaacuaggugauaggaguuuauugcauucuucuc

SEQ ID NO: 55154 - RNA, 69 nt, Homo sapiens
gaggaggaggagggggaggaggaggaagaaucuguauuuucuugcuuguuguucccuucauuuuuccuc

SEQ ID NO: 55155 - RNA, 123 nt, Homo sapiens
gaggaggaggccuugauggugcgcauucgagcugaucuuuucugauuccagugggaccucucucugccaaccuccacuaggagucucaaaaagacucagcccugcuucauccagacuccccuc

SEQ ID NO: 55156 - RNA, 57 nt, Homo sapiens
gaggaggauuugagaggagacaaaagagaaaucuguuagcuugucaaaucuuuccuc

SEQ ID NO: 55157 - RNA, 56 nt, Homo sapiens
gagcuggacuucuuaccuuuucaaagaccaagaaaagucugagaugauuccagcuc

SEQ ID NO: 55158 - RNA, 97 nt, Homo sapiens
gagcuggauggaugauguguuuuaggaucucagcauaguaugggccaaauaccugcugauuaugaugcaucagauugagaaacuuccagcccaguuc

SEQ ID NO: 55159 - RNA, 87 nt, Homo sapiens
gaggaucacuugaacccuggagguugaggcugcagugagcagugauugugccauugcacuccagccugagugacagagugagacuuc

SEQ ID NO: 55160 - RNA, 98 nt, Homo sapiens
gaggcaggagaaucacuugaaccugcgaggcggagguugcaguaagccgagacugugccacugcacuccggccuggcaacagagugagacuccgucuc

SEQ ID NO: 55161 - RNA, 99 nt, Homo sapiens
gaggcaggagaaucacuugaaccugggagguggagguugcagugagcugagaucaugccauugcacuccagccuuggugacagagugagacuccgucuc

SEQ ID NO: 55162 - RNA, 99 nt, Homo sapiens
gaggcaggagaaucacuugaucccaggagauggagguugcagugaaccgagaucaugcuguugcacuccauccugggcgacagggcaagacuccgucuc

SEQ ID NO: 55163 - RNA, 98 nt, Homo sapiens
gaggcaggagaaucacuuggaacagggaggcguagguugcagugagccaagauugcuccauugcacuccauccuuggcaacgagugaaacuccaacuc

SEQ ID NO: 55164 - RNA, 100 nt, Homo sapiens
gaggcaggagaaucgcuugaacccaagaggcagagguugcggugagccaagguggugccauugcacugcauucugggcaacaagagcgaaauuccguuuc

SEQ ID NO: 55165 - RNA, 100 nt, Homo sapiens
gaggcaggagaaucgcuugaacccaggaggcggagguuguggugagcgaagaucgugccauugcacuccagccugggcaacaagagcaaaacucugucuc

SEQ ID NO: 55166 - RNA, 97 nt, Homo sapiens
gaggcaggagaaucgcuugaacccgggcagagguuguggugagcaaagauugcgccauugcacuccagccugggcaacaagagugaaacuucgucuc

SEQ ID NO: 55167 - RNA, 104 nt, Homo sapiens
gaggcaggagaaucgcuugaacccuggagguggaggcuguggugagcugagauugccccauugcacuccagccugccugggcaacaagagugaaacucugucuc

SEQ ID NO: 55168 - RNA, 100 nt, Homo sapiens
gaggcaggagaaucguuugaaccugggaugcggagguugcggugaguggauauugcgccauugcacugcagcccgggcaacaagagcgaaacuccgucuc

SEQ ID NO: 55169 - RNA, 99 nt, Homo sapiens
gaggcaggagaauugcaugaacccggcaggcggagguugcagugagcagagauugcgccauugcacuccagccugggcgacaaagcaagacuccgucuc

SEQ ID NO: 55170 - RNA, 100 nt, Homo sapiens
gaggcaggagaauugcuugaacccaggaaguggaggcuucagugagcugagaacacgccacugcacuccaguccugggcaacagagcaagacucugucuc

SEQ ID NO: 55171 - RNA, 71 nt, Homo sapiens
gaggcuuucuggucuaaaggcacaggcaagggaguguuggccauuugucuccuagacgaccaggcggccuc

SEQ ID NO: 55172 - RNA, 121 nt, Homo sapiens
gagggcagagauggcagcaagcauuccuuggcugaggccugcauugaacuagaaggcuguugauaaggcuuaucauggggacugcagccuagccucggauagcuccuccauccuucuccuc

SEQ ID NO: 55173 - RNA, 60 nt, Homo sapiens
gaggguacagggcuaaacaagucaucuccauaaagguccucuugccuagcccuuugccuc

SEQ ID NO: 55174 - RNA, 89 nt, Homo sapiens
gagguaacacuguagcugagggcaugcguucaggaguuaaucugcccaauucaaauucuggcuugacagccuucuagcugcaugaccuc

SEQ ID NO: 55175 - RNA, 65 nt, Homo sapiens
gagguaagagggagucacacaaaauaguaagguuucauucuuauguagucauuccuuuuugcuuu

SEQ ID NO: 55176 - RNA, 63 nt, Homo sapiens
gagguaugagcugagaaauccuccuccuuugagacaacugcucacuuucucaguucugaucuc

SEQ ID NO: 55177 - RNA, 92 nt, Homo sapiens
gaggucauucaaugcucucucugaguuucagggaacuuagcaauucuuaaguucauucaugaaacuuaguucugaggguaccagcaggcuuc

SEQ ID NO: 55178 - RNA, 100 nt, Homo sapiens
gaggugagaggauugcuugaucccaggaggucgaggcugcagugagccaugauggcccuacugcacuucagccuugggaaacagaguaagacccugccuc

SEQ ID NO: 55179 - RNA, 103 nt, Homo sapiens
gaggugggaggaucgcuugagcccaggagguggagguugcagugaccuauggucgcaccacugcacuccagccuuggccacagagcaagaacucccccgccuc

SEQ ID NO: 55180 - RNA, 98 nt, Homo sapiens
gaggugggaggauugcuuguuccccggagguugaagcuacagugagccuugauugugucacugcacuccagccugggcaacagguaagacucugucuc

SEQ ID NO: 55181 - RNA, 123 nt, Homo sapiens
gaggugggagguucgauugagaccaggaggcagaggcugcagugaguugagaucaugccgcugcagugaguugagaucaugccacugcacuucagccugggugacagagcgaaacccugucuc

SEQ ID NO: 55182 - RNA, 99 nt, Homo sapiens
gagguggggucuugcucuguugcucaggcuggagugcaguggugugauuauagcucauuuuagccuugagcucaugggcucaggcaguucuccuaccuc

SEQ ID NO: 55183 - RNA, 111 nt, Homo sapiens
gaggugggguuuuuuuguuuguuuuugcuuuguuuugagacagagucuugcucuguugcccaggcuggagugcaauggcacgaucucgucucacugcaagcucuccgccuc

SEQ ID NO: 55184 - RNA, 74 nt, Homo sapiens
gagguuaugauuuguuucaggaguuuucuaggaguugagguucccaucagaaaacucagaggccaauagaccuu

SEQ ID NO: 55185 - RNA, 73 nt, Homo sapiens
gagguucuacuggcauuuaguggguagaggacaaggauggcacuaaauauccuacaaugcacaggagagccuc

SEQ ID NO: 55186 - RNA, 88 nt, Homo sapiens
gaguaaacaaagugcaugacugauauuugagauacuucaugccuuaucucuggauaucuacuuauguucuauuuucauuuguuuguuu

SEQ ID NO: 55187 - RNA, 59 nt, Homo sapiens
gaguaacagcauaaauuugugacuuguuguacuggauaauucaggaguuaguugugcuc

SEQ ID NO: 55188 - RNA, 58 nt, Homo sapiens
gaguaacaugaacuuucaaauauggacuuuucuuaagcccuuuggcuguucaugacuc

SEQ ID NO: 55189 - RNA, 64 nt, Homo sapiens
gaguaagugcucuugaaacugccuuagcaaaauuaugacugagacagugaaagagauuuaacuu

SEQ ID NO: 55190 - RNA, 58 nt, Homo sapiens
gaggcggagguugccaccacugcacuccagcuugggugacauggcgauacuccgucuc

SEQ ID NO: 55191 - RNA, 80 nt, Homo sapiens
gaguaccuagcagacaugggcugaaccacacaaaaucaucuauaaguggucuccacaugcuuugcucuguccaagcacuc

SEQ ID NO: 55192 - RNA, 59 nt, Homo sapiens
gaguagccaguauuuccacagagugggguuacuucuaauuugugcuaaucuggauauuu

SEQ ID NO: 55193 - RNA, 101 nt, Homo sapiens
gaguagcugggauuaaagcgugugccaccauguccggcuaauuucuuuguauuuuuaguagagauggguuuucacauguuggccaggcuggucucgaacuc

SEQ ID NO: 55194 - RNA, 56 nt, Homo sapiens
gaguagcuguacuaucuuacauuccugccagcaauguaugagagacauggcugcuu

SEQ ID NO: 55195 - RNA, 126 nt, Homo sapiens
gcauaguauuccaugguuguauguaucacauuuucuuuauucaauaugucauuggcaggcauuuagguugauuccaugucuuugcuauugugaagagugcugcaaugaacauucgugugcaugugu

SEQ ID NO: 55196 - RNA, 92 nt, Homo sapiens
gcauauaauagcaaaaauaguaauaauaguuguuaauauuuauuuagaacugccaauuguugacaaugcacugugcuaagugcuuuauaugc

SEQ ID NO: 55197 - RNA, 57 nt, Homo sapiens
gcauauugguauaggucuauuucugaguuuucuuuucugaucuguugaucaaugugu

SEQ ID NO: 55198 - RNA, 77 nt, Homo sapiens
gcaguuuucuagcaguggaaucuguuauacuaacucuuugaaugaguaacugaaacagauucugaaacugaaacugc

SEQ ID NO: 55199 - RNA, 67 nt, Homo sapiens
gcauaaucuacuugacugaguacaggagaguaacaauagucuucauagucuaugcaaguaagagugc

SEQ ID NO: 55200 - RNA, 92 nt, Homo sapiens
gcaucacugguuagaggaauaauugauuaggggucaccgauggggguuauuaguuggagagucacuaguuagugcuaauagccaagagaugu

SEQ ID NO: 55201 - RNA, 62 nt, Homo sapiens
gcaucuccaggauuuucacacucagagaugaccacucuuaugaguagaacuccuggagaugu

SEQ ID NO: 55202 - RNA, 78 nt, Homo sapiens
gcaucugaauauagaaucaucugugcacuaguaaauuaagcuguauacuagucauuuaggugauauuauaacagaugu

SEQ ID NO: 55203 - RNA, 61 nt, Homo sapiens
gcaggugagccuuccagguguggguccccuccugggcacucacugugagaguuuauccugu

SEQ ID NO: 55204 - RNA, 94 nt, Homo sapiens
gcagucagagggcagagaaaggcagggaccuucaguugcacaggaaggucugcaucuggguccguucugcuucucacugcacauguggccuugc

SEQ ID NO: 55205 - RNA, 112 nt, Homo sapiens
gcagugcauggugguguacaccuguagucccagcuacuuagggggcugagguaggaggauuaccucagcccggggaaguugaggcugcagugaaccaugaucacaccacugc

SEQ ID NO: 55206 - RNA, 79 nt, Homo sapiens
gcaguucgcuucaagguuauaucuuaaaauccaagagaaaggggaaaaaaaguuaagaugcauuuugaaguuaagcugc

SEQ ID NO: 55207 - RNA, 94 nt, Homo sapiens
gcagggaaacucagacucagggaguggaggggcuugggggugggaacccagccccccauguucucucugcagcuccacaccacuguucaccugc

SEQ ID NO: 55208 - RNA, 67 nt, Homo sapiens
gcaugucauguuucuacugaccaaauucugggagucuccccuuuggguaaaaacauaacacucuugc

SEQ ID NO: 55209 - RNA, 71 nt, Homo sapiens
gcaugaucuauaguauagcauauuaagcauuuguacuuccccagaugcauugguggcauauucauccgugu

SEQ ID NO: 55210 - RNA, 58 nt, Homo sapiens
gcauguucagcuuuaguauguuuucagaaaugcauuacauaaagaagcaggacauugu

SEQ ID NO: 55211 - RNA, 87 nt, Homo sapiens
gcauuacaauggcaaugaaauagugagaguggauaaccucgucuuguuucgauuucaaagcuuucaauauuuuaucauuguguaugu

SEQ ID NO: 55212 - RNA, 71 nt, Homo sapiens
gcauuacauagucaaggugucucauuucuaacaaauaccagaaauuacacuuguaaauggcauguaugugu

SEQ ID NO: 55213 - RNA, 94 nt, Homo sapiens
gcauuauaaagaugugcaaauucauguucuuuacucuucgaaguauggaauguagagaguauguguuuguauauauuuaaauaaauauuaaugc

SEQ ID NO: 55214 - RNA, 63 nt, Homo sapiens
gcauuaugccuuagauauugaauggcuagauuuacuaguagcaauggcucugagcuaucuugc

SEQ ID NO: 55215 - RNA, 92 nt, Homo sapiens
gcaugcaggcuuaauacaugggugauagguucauaggugcagcaaaccaccauugcacacauuuaccuauguaaaaaaccugcacauccugc

SEQ ID NO: 55216 - RNA, 64 nt, Homo sapiens
gcaugcgggccugggcuuggcagggucccaucauucuuuuuucugcagccauucagcccuaugc

SEQ ID NO: 55217 - RNA, 59 nt, Homo sapiens
gcaugcuuccucacuaagcuuagccauuucuagcuugugauuuagagugagagacaugc

SEQ ID NO: 55218 - RNA, 67 nt, Homo sapiens
gcauggaugugaaaucauaguuucuaguaagacacagaaacguguaugugauauucacauagguugc

SEQ ID NO: 55219 - RNA, 57 nt, Homo sapiens
gcauggcaauaugaugcacuguuugcgggaguccugcgagggcacauuguuccgugc

SEQ ID NO: 55220 - RNA, 128 nt, Homo sapiens
gccaauuuaaauuugaauuucagauaaaugauacauuuuuuaguacaagucugucccaugcaauauuugggaucaacuuauacuaaaauuguuuuguuguuguuucucugaagucaaauuuaacuggc

SEQ ID NO: 55221 - RNA, 112 nt, Homo sapiens
gccaaggacaugagcaaccacagaccugugcauaugcaugugcaugcacguggaccuucacgccgugugcaugcuuuuguaugucuacaggcuuuuuggagaugugccuggc

SEQ ID NO: 55222 - RNA, 67 nt, Homo sapiens
gcaugguguuaggcacugggaauggaauacugaacaaaucagagacauucuugccuucaccgagugc

SEQ ID NO: 55223 - RNA, 94 nt, Homo sapiens
gccaaaugcuuugcuagagcugguaaaauggaaccaaaucgacuguccaauggauuugguccccuucaaccagcuguagcugugcauugauggc

SEQ ID NO: 55224 - RNA, 60 nt, Homo sapiens
gcauuuugugauauccgaccaugaaguuaugucuauugugugucuuuuaucacacaaugu

SEQ ID NO: 55225 - RNA, 60 nt, Homo sapiens
gccaaagagguuuaguuuguugagguuuuguaaaaccuggcacuuagcaaaucugauggc

SEQ ID NO: 55226 - RNA, 58 nt, Homo sapiens
gcccaggauggagugcagugauacgaucuuggcucacugaaaccacugccuccugggu

SEQ ID NO: 55227 - RNA, 64 nt, Homo sapiens
gcccaggauuuugaagcugcagugagcuaugaucacaguugugccauugcacuccagcuugggc

SEQ ID NO: 55228 - RNA, 66 nt, Homo sapiens
gccccuccuucuagagaggugagcuggagaaggucauuuucucaguuccuacuuuggugaaggggu

SEQ ID NO: 55229 - RNA, 71 nt, Homo sapiens
gccaguauuuuauugaggauuuuugcaucaauguucaucaaggauauuggccuaaaauucucuuuuuuggu

SEQ ID NO: 55230 - RNA, 64 nt, Homo sapiens
gcccuaaaguagaauaaccuuuucuuucuccaugaauggaauguaaguuauguuugcugagggc

SEQ ID NO: 55231 - RNA, 58 nt, Homo sapiens
gcccuagaacucgaggcuauagugaacuaugauugcacuauugcacuccagucugggc

SEQ ID NO: 55232 - RNA, 70 nt, Homo sapiens
gccauguacauaguagacacugaaaauauauauauauauauauuuauucagugucuaguaucugccuggu

SEQ ID NO: 55233 - RNA, 58 nt, Homo sapiens
gcccaacaaccagaacucaguccacugaaagguaggaaaugcagucuuuguucugggc

SEQ ID NO: 55234 - RNA, 74 nt, Homo sapiens
gcccaccaaggcagacuguggaguucuuucucaguggugagacaaaggcccauagcugcuuggcuggccugggc

SEQ ID NO: 55235 - RNA, 66 nt, Homo sapiens
gccaggcaaaggcuuccacugcauccuuccaggcauguggaggauaaacacggagcuuccccuggc

SEQ ID NO: 55236 - RNA, 71 nt, Homo sapiens
gccaggcaacauuuaccucaaucuugcugaagagcccuugggcuuaaagcgaauauuggugguauccuggc

SEQ ID NO: 55237 - RNA, 66 nt, Homo sapiens
gccacugggccuugccuacuuauguaauuuuuaaaaauuacaugucuugguaagguuagaaguggc

SEQ ID NO: 55238 - RNA, 69 nt, Homo sapiens
gccaauaucaaugaccaugguccagggaacagucucaagaaguccugagaacaugcacuugagguuggc

SEQ ID NO: 55239 - RNA, 67 nt, Homo sapiens
gccaaugccuggcaugcaugcauucauucauucacugauaggauuuugcuauguuguccaggcuggc

SEQ ID NO: 55240 - RNA, 79 nt, Homo sapiens
gcccucgcuuucagagucaucugcccaaguacaguaaacagauccagcuacuacuuagauacuuugagaaguuuagggu

SEQ ID NO: 55241 - RNA, 58 nt, Homo sapiens
gcccugagagcaguguuucggacgcugggaagcgcgcugugcaaagcgcucucggggu

SEQ ID NO: 55242 - RNA, 88 nt, Homo sapiens
gccuacuacacagccaggauuuguaguguaccuaauguucuuaggcuacaaaccuauacagcaaguuacugugcugaauacuguaggc

SEQ ID NO: 55243 - RNA, 66 nt, Homo sapiens
gccuagagcuucaaaguuggcuaggagacaccccaggggugucuuaggaucaauuuuggauugggc

SEQ ID NO: 55244 - RNA, 71 nt, Homo sapiens
gccgucagccgaacuuaggguuacucugaaauaugcucuguauauuagaacuagaggaguuugagugaggc

SEQ ID NO: 55245 - RNA, 130 nt, Homo sapiens
gccuaugacaucuggguugguuccaagucuuugcuauugugaauggugccgcaauaaacauacaugugcaugugucuuuauagcagcaugauuuauaauccuuuggguauauacccaguagugggauggc

SEQ ID NO: 55246 - RNA, 77 nt, Homo sapiens
gccucuucucaagaaagugcuguagacugggcgcaguagcuacugccuguaauuccagcacuuugggaagcugaggc

SEQ ID NO: 55247 - RNA, 124 nt, Homo sapiens
gccugacuagcuaccuacuguaacaaaaucuguaucaugucuucccagugauucuauauuuugguaauauagaaucaacuuguggagaaggcagcaugauguagugaacaaagcuucagcaggc

SEQ ID NO: 55248 - RNA, 92 nt, Homo sapiens
gccugacucuuggcaagugcuugaugaaugaucaauauuauuauuacuauuguuguuauuauuacuaagucuuccuaagaagagucaugggc

SEQ ID NO: 55249 - RNA, 77 nt, Homo sapiens
gccugagaaauuagcauggucacuuugggccccauaccuugggguaugugggcucugaccugacuuuaaauccaggc

SEQ ID NO: 55250 - RNA, 69 nt, Homo sapiens
gcuuucugaggccucaccagaagcagauggcaacacuacgcuucuuguaaagccugcagaaccauuagc

SEQ ID NO: 55251 - RNA, 77 nt, Homo sapiens
gcuuugcccugagaugcuguuaaucuguaacuuuagccccgaccuugagcucacagaaacauguguuuuauggaacc

SEQ ID NO: 55252 - RNA, 94 nt, Homo sapiens
gcuuugcgcuaauggacuguuauaaaaugcacaguuguuucuugcagucacugccaaaugccucccauucuacugacaguuuugugcauuaggc

SEQ ID NO: 55253 - RNA, 78 nt, Homo sapiens
gcuuugcuagagcugguaaaauggaaccaaaucgccucuucaauggauuugguccccuucaaccagcuguagcuaugc

SEQ ID NO: 55254 - RNA, 58 nt, Homo sapiens
gcuuugggauuccuuauuuuuggaugaguggcuuugaaagugaauguaucccguaagu

SEQ ID NO: 55255 - RNA, 62 nt, Homo sapiens
ggaaaaggggauuaagggaaaguuuacgugcugcauggugagacacuucccagaucccuucc

SEQ ID NO: 55256 - RNA, 108 nt, Homo sapiens
ggaaaaucuuucuuuguccucaagauaauaauuaaaaauagucuaugcaagauuuauuuugaauagaagguuuuuuguucagauuaucauaggaaagagaauauuucc

SEQ ID NO: 55257 - RNA, 73 nt, Homo sapiens
ggaaagacaccuuacuauguuaauauggguuacuacugggcaaugggauuauacauggcugauggguuuuucu

SEQ ID NO: 55258 - RNA, 84 nt, Homo sapiens
gcuuguucuaaacgugaauucaccugacucccugaaagaacauucucuuucauggaacaaguggguucaaagcacagaguaagc

SEQ ID NO: 55259 - RNA, 115 nt, Homo sapiens
gcuugcuuuguuaaaugugugaaaugagaaaguggacuaagugaauaugaauagaauuggauauauuuauacauuugcuuuauuugaaaguuuaacuaugcuuaauauugcaggu

SEQ ID NO: 55260 - RNA, 62 nt, Homo sapiens
gcuuggcagcacgcaguccagaggcucccggagccaggcccucugcggauguuugcugcggc

SEQ ID NO: 55261 - RNA, 55 nt, Homo sapiens
gcuucucuaguugccuggagcauaguaauaugauuuuccagcacauuagggaagc

SEQ ID NO: 55262 - RNA, 83 nt, Homo sapiens
gcuucuuucacugagaaugauguuucugagguucguccacacugaggcauguaucagaacuucauucuuuuugaugacugagc

SEQ ID NO: 55263 - RNA, 64 nt, Homo sapiens
gcuugaagcugagaggcagagguugcggugagccgagauugcgccauugcacuccagccugggc

SEQ ID NO: 55264 - RNA, 107 nt, Homo sapiens
gcugugugugcauaugugaacacauacaugcaugggcaugugugcaugugaaugcaugucaugugcaugcaugagccauguguggugugugcaugugugugugcagc

SEQ ID NO: 55265 - RNA, 83 nt, Homo sapiens
gcugucucucauuagccauaggguguguugugguguccagugugacauuauuagguuaaccuauagcuacaugugaugauagu

SEQ ID NO: 55266 - RNA, 115 nt, Homo sapiens
gcugucuuuggaaaucugccauagauauucauggaauuaauuaaaauauacuggauuuaaauggagauagauagauugauugauugauguacaugauuuaagguauagagucagc

SEQ ID NO: 55267 - RNA, 69 nt, Homo sapiens
gcugguuuauuguuauuuauauccacagacacaaaaucuguacccuccagugauaacaguggacuaugc

SEQ ID NO: 55268 - RNA, 99 nt, Homo sapiens
gcuguaaccuuuucagaugaugccgcugaaaaccuuaaaguacuguuguguuuucacagugcuguuguguuuucacguggucacaccucucugugcagc

SEQ ID NO: 55269 - RNA, 119 nt, Homo sapiens
gcuguauuucuucuccuuugacuuagaauggaagguugagaagaacuguggccuguucaaccccaggccuucucuuagcacuuuguguuacuguguugggggccaaaaaggaaucaggc

SEQ ID NO: 55270 - RNA, 73 nt, Homo sapiens
gcuguuguguuauggaagcuaugccagcuggcaccuuucuugguucagugccucaguuuuuaaagaugacagc

SEQ ID NO: 55271 - RNA, 65 nt, Homo sapiens
gcuuaagggaaugugguagcugguuugaucgucuauccagaccacuuaaauuuuccuauaucagc

SEQ ID NO: 55272 - RNA, 63 nt, Homo sapiens
gcuuaagggaauguuguggcugguuugaucuguucagaccaccaaaacuuucuccauaucagc

SEQ ID NO: 55273 - RNA, 74 nt, Homo sapiens
gcuuagagcaccauuagcguugggccggugccacagagcaaauaggacugagccccaucugaggugcccagagu

SEQ ID NO: 55274 - RNA, 59 nt, Homo sapiens
gcuuagcaaacugagagccacuaucuauuuuacagagcauggcucuuugcugcuaaagu

SEQ ID NO: 55275 - RNA, 98 nt, Homo sapiens
gcuuagcuauccagaaaacauaaaauguggacaucggaggaaaaaagaaccauucuugggguuuccagguggccaacauuuuacuguguggcauaggc

SEQ ID NO: 55276 - RNA, 70 nt, Homo sapiens
gcuucaaaacuucaaagaacaggcugauuauuguuagggucuacugcagcuggugacuuuaaguugaagc

SEQ ID NO: 55277 - RNA, 72 nt, Homo sapiens
gcuucccaagaauugaaugauugucuuaugagagagugaaauuuccaucaucaggcucauucaagcugaagu

SEQ ID NO: 55278 - RNA, 55 nt, Homo sapiens
gcuuccaaucauggugaaaggcaaguggggagccagagucucacaugguggaagc

SEQ ID NO: 55279 - RNA, 74 nt, Homo sapiens
ggaauaaaaaauggcuauuccauaggcagagcaauggcuugagcugcucaacuaaggauacuuauuauuauuuc

SEQ ID NO: 55280 - RNA, 61 nt, Homo sapiens
ggaaguuccugaaguucagguaugaaaaaagcaauuggaagauacuggcucgggaauuuuc

SEQ ID NO: 55281 - RNA, 122 nt, Homo sapiens
ggaagaggaugguggccagggguggcauuggcagccacagagagugcuuggcaucugcugacgggccguacgguggauccuggacacucuuggucuacccccacgccacccacacugcuucu

SEQ ID NO: 55282 - RNA, 68 nt, Homo sapiens
ggaagaugaaaggauagucugaugccauguaaaaaauuuaggauaugagauuauaaucuuuuacuucu

SEQ ID NO: 55283 - RNA, 97 nt, Homo sapiens
gcuuuuuauguuccuauagcauuuguacaaaaugcaguaggaguggaaucauuauucuaaauugcauaaguacaaaugaaauggaagagcacaaagc

SEQ ID NO: 55284 - RNA, 71 nt, Homo sapiens
gcuuuuuuuuagaguaagauuuuaccacugugggaaaaacauagcuguuuaauacucuagguuaagagagc

SEQ ID NO: 55285 - RNA, 69 nt, Homo sapiens
ggaaauuguguucuggagauaaagccaagguuguagcuggacaacuuuugcuagugcuuuagaacuucc

SEQ ID NO: 55286 - RNA, 93 nt, Homo sapiens
ggaauccccuuuguagguuucauaguuuauacugauauuucugaugucgucucagagaauuagucacaauuauaggaacucagaaggcauucc

SEQ ID NO: 55287 - RNA, 74 nt, Homo sapiens
ggaaucucacuccuaccacuuaacuaugucacuuaaauuaaccuugugugacugggaguggugaagauaauucc

SEQ ID NO: 55288 - RNA, 63 nt, Homo sapiens
ggaaugacauuccacagccguagaggagccaggcuagccucagcccuguaggagugacguucc

SEQ ID NO: 55289 - RNA, 129 nt, Homo sapiens
ggacauucacuaagcccaucaugcauguuauuagagaguuggcagcauuccagccaagcacauaaagugcuggcaccagaaugacugcagacucucauguccacagcagcuguuaggucugugaugucc

SEQ ID NO: 55290 - RNA, 57 nt, Homo sapiens
ggacauuuugucucaguuucauuaagucuucuuauuugaacacuggacugagugucc

SEQ ID NO: 55291 - RNA, 67 nt, Homo sapiens
ggaccacauuaccuugcuugcuccaacuuuauaguaagucuugaagucagguaauguaauguaauuc

SEQ ID NO: 55292 - RNA, 67 nt, Homo sapiens
ggaccugagggaaaaaauuuauaugagcugacgaaaauguugauggagagaauuauucucucagucc

SEQ ID NO: 55293 - RNA, 90 nt, Homo sapiens
ggagaagcagcauucuauaguccuaggauugggucucagccuuuucgugagccuguguccccagccugugaccuucaugggugcuucucc

SEQ ID NO: 55294 - RNA, 75 nt, Homo sapiens
ggagaaggaaagaaaaaguaaagugcauuugauaaauucaaaugcucucuacacguuucugggcacacuuucucu

SEQ ID NO: 55295 - RNA, 79 nt, Homo sapiens
ggagaaggauguccauuucaaaccucauuugcagcugcuuuuuagucuuagugguuuuggaauggaauucaucugcuuc

SEQ ID NO: 55296 - RNA, 99 nt, Homo sapiens
ggagaaggucucaggagcauauugggucagguauguguggaaaggcccuccaggcucaaauucacacugggccuacucugugcccugacuccaagcucc

SEQ ID NO: 55297 - RNA, 89 nt, Homo sapiens
ggagaaucacuugaaccagggaggcagagguugcagugagccaagguugcgccauugcacuccagccucggcaacaagaaugaaacucc

SEQ ID NO: 55298 - RNA, 89 nt, Homo sapiens
ggagaaucacuugaacccaggaggaggagguugcagugagcagagaucaugccauugcacuccaucuugggcaacaagagugaaacucc

SEQ ID NO: 55299 - RNA, 89 nt, Homo sapiens
ggagaaucacuugaaccugggauggagagguugcaaugagccaagguugcgccauugcacuccaucccgggaaacaagagcaaaacucc

SEQ ID NO: 55300 - RNA, 89 nt, Homo sapiens
ggagaaucgcuugaacccaguaggcggagguuacagugagccaagauggcaccauuguacuccagccuuggggacaagagagaggcuuc

SEQ ID NO: 55301 - RNA, 89 nt, Homo sapiens
ggagaaucgcuugaacccgcgagguggagguugcagugagccaagauugugccauugcacuccagcuugggcaacaagagugaaacucc

SEQ ID NO: 55302 - RNA, 89 nt, Homo sapiens
ggagaaucgcuugaacccgggagguggagguugcggugagcugagauugcgccacugcacuccagccucggcaauaagagcgaaacucc

SEQ ID NO: 55303 - RNA, 89 nt, Homo sapiens
ggagaaucgcuugaaccuggaagguggaguuugcagugagcugagaucgcgccauugcacuccagcuugggcgacaagagcgagacucc

SEQ ID NO: 55304 - RNA, 89 nt, Homo sapiens
ggagaaucgcuugaaccugggaggaggagguugcagugaggugagaucgccccauugcacuccaccuuggguaacaagaacaaaacucc

SEQ ID NO: 55305 - RNA, 89 nt, Homo sapiens
ggagaaucgcuugaagccgggaggcggagguugcagugagccaagauugugccacugcacuccggccugggcaacaagagcgagacucc

SEQ ID NO: 55306 - RNA, 88 nt, Homo sapiens
ggagaaucgcuuggacccaggaggcagagguugcaaugagcugagauugugccauugcacugcuucuugggugucacagcgacacucc

SEQ ID NO: 55307 - RNA, 88 nt, Homo sapiens
ggagaauggcaugaacccgggagguggagcuugcagugagcagagaucacgccacugcacuccagccugggcaacagagcgagacucc

SEQ ID NO: 55308 - RNA, 88 nt, Homo sapiens
ggagaauggcaugaacccuggaggcggagcuugcagugagcugagauagcgccacugcacuccagccugggcaacagagccagacucc

SEQ ID NO: 55309 - RNA, 89 nt, Homo sapiens
ggagaauugcuugaacccaggaggcggaagguacagugagcugagaucacgccauugcacuccagcucugggcgacagagcaagacucc

SEQ ID NO: 55310 - RNA, 89 nt, Homo sapiens
ggagaauugcuugaacccgggagguagagguugcagugagcugagaucgcgccauugcacuccagccugaccaacaagaacgaaacucc

SEQ ID NO: 55311 - RNA, 88 nt, Homo sapiens
ggagaauugcuugaaccugggaggcggggguugcagugagccgagauugugccacugcacucccgccugggugacagagcaagacucc

SEQ ID NO: 55312 - RNA, 88 nt, Homo sapiens
ggagaauugcuugaucccgggaggcggagguugcaguaagccgagaucgcgccacugcacuccagccuuggcggcagagcgagacucc

SEQ ID NO: 55313 - RNA, 71 nt, Homo sapiens
ggagagaagagaaauuguucacauuccaugcuguuuuucuggcauggaaugugaauaacuuccuucacucu

SEQ ID NO: 55314 - RNA, 74 nt, Homo sapiens
ggagagaagagaugcagccacucagggagcccagaccugggagcuccccgagcccaggcugugacucccucuuu

SEQ ID NO: 55315 - RNA, 71 nt, Homo sapiens
ggagagcuggcuuucuccugaucucaggccuggauacugcccgccagggugucgggagaagccaccuuucc

SEQ ID NO: 55316 - RNA, 97 nt, Homo sapiens
ggagauaacaguucaccaacuaugugcacaugcccuggugacuguaucccacuauguggcaccagguuguguguuuauuugccgaggcucuuucucc

SEQ ID NO: 55317 - RNA, 64 nt, Homo sapiens
ggacucugcugguuuuguucacugcuguauccccggagcccagaacagugcuuaguagauguuc

SEQ ID NO: 55318 - RNA, 78 nt, Homo sapiens
ggagaaaagcccccaugauucaauuaucucccacugggucccucccaugacagguuggaauuaugggagcugcaauuu

SEQ ID NO: 55319 - RNA, 68 nt, Homo sapiens
ggagaugcuguguugcuggcuuaaagauggagaaagagauccaugagccaaggaauacagcagccucc

SEQ ID NO: 55320 - RNA, 97 nt, Homo sapiens
ggagauggacaagauguagaacacugaguucagggucagcccaggacagcuccuaacagccugacauguacuuauuuguuuucucuugucuauuucc

SEQ ID NO: 55321 - RNA, 60 nt, Homo sapiens
ggagauguccuaagugguuaacucuauugaaagagucacauaagugcauaggauauuucu

SEQ ID NO: 55322 - RNA, 60 nt, Homo sapiens
ggagauguccuaagugguuaacucuauugaaagggucacauaagugcauaggauauuucu

SEQ ID NO: 55323 - RNA, 69 nt, Homo sapiens
gcuacugugcaaaaaugaauauuguaauauuaaaagagaaacuaauuguucaguaucauugcacauagu

SEQ ID NO: 55324 - RNA, 84 nt, Homo sapiens
gcuaguguaggcagccagcuguggauugaagaguuugcugagucaauugguauaaauuuggauccaaggcuggccuaugauagc

SEQ ID NO: 55325 - RNA, 57 nt, Homo sapiens
gcuaacaaguuucuugguucuccagcuugcacguggccuauuaugagacuucuuagc

SEQ ID NO: 55326 - RNA, 69 nt, Homo sapiens
gcuaagauuucagcuugauguuauuaguuaucauguuaaugauaacagauaaugucaguuaucaugggc

SEQ ID NO: 55327 - RNA, 72 nt, Homo sapiens
gcuaagcuucauacaguggcugcacuccagccaguaaaaaggcuggagugcagucacuguguguagcuuagc

SEQ ID NO: 55328 - RNA, 74 nt, Homo sapiens
gcuauugucacauugaugcccaugguggaugggcuaagcauaggcagccaucaggggcuucggguggagauagu

SEQ ID NO: 55329 - RNA, 86 nt, Homo sapiens
gcuauuuucaaauaucccaauguaauaucacaaagguuuaaucaagucauaucugugugaugaaaaacauggguuugaaaaauggu

SEQ ID NO: 55330 - RNA, 81 nt, Homo sapiens
gcuauuuuguuuuauacuguuuuacaucauugccuuuccccucuaauagagugugaucucuaaaacaggaaagacagcagc

SEQ ID NO: 55331 - RNA, 88 nt, Homo sapiens
gcucaaaauaauccuuauccaaaguggcauauuauaggguagcauauucugaucuucuauaacagugugguuuggagauugauugagu

SEQ ID NO: 55332 - RNA, 105 nt, Homo sapiens
gcucaaagaggugagguaacucucccaggguuccacgccuggcugugugcaugaccugcuacaaccagcaugaaaccuugagcagguuacuucacuucucugagc

SEQ ID NO: 55333 - RNA, 66 nt, Homo sapiens
gcucacaaagaaauuccugucuucucuuuagguaauccacagaugacuagaaauuauuuagugagc

SEQ ID NO: 55334 - RNA, 80 nt, Homo sapiens
gcucaguguguuguugauugaauuuacuuuucauucuaaugaacuugagaacauuaauaguuaauuuugccaugcugagu

SEQ ID NO: 55335 - RNA, 75 nt, Homo sapiens
gcuccccuaucacuguaaguuuacacuuuguagcuaauuuagcuacaaaguguaaacuuacagugacaggagagu

SEQ ID NO: 55336 - RNA, 67 nt, Homo sapiens
gcucuuuguaugucaugacaacugugccaauuauuuuuggcacaguucacuuuuuauaucaaagagc

SEQ ID NO: 55337 - RNA, 68 nt, Homo sapiens
gcugaacuguuucuggugaaagaguagccuuccuucgcgggcacugacacugagggaagcagcucagu

SEQ ID NO: 55338 - RNA, 112 nt, Homo sapiens
gcucuccuugggccuuagugucagcucuaaagauuuauaaagguugcacuggaaccucuuuccaguuguuauuuuuauaaaggaucagugacauuuugaggcagauaagagc

SEQ ID NO: 55339 - RNA, 65 nt, Homo sapiens
gcugacucaguagguaagacauugccacucacaaggguaagugcuguguuguuaccuaaggcagu

SEQ ID NO: 55340 - RNA, 57 nt, Homo sapiens
gcugacucaguuucucagguaguaaucuacuauagacugcugccaaacuggggcagu

SEQ ID NO: 55341 - RNA, 58 nt, Homo sapiens
gcuggagggcaggggugugaccauaguucacuguagccucaaauucuuggccuccagc

SEQ ID NO: 55342 - RNA, 82 nt, Homo sapiens
gcuggagugcagugacaguggagacuuacuucagccuccaccucccaggcucaagugauucucaugcuucagccucuccagu

SEQ ID NO: 55343 - RNA, 85 nt, Homo sapiens
gcugaccuggugcuguagccugauugaggggcacagccuuuuccccagucuuggugucuguagcacguauguucuuagucucagc

SEQ ID NO: 55344 - RNA, 129 nt, Homo sapiens
gcugcuaagaugagucucuagaucacuugucaucauuauguuguguggcugauaaagacuuuaucuuuaaugcaucccaaaauguaguugcugacuucccuguauuucuuuauucacucauuuuuucau

SEQ ID NO: 55345 - RNA, 81 nt, Homo sapiens
gcugaggcaggagaauggcgugaacucgggagguggagcuugcagugagccaagaucgcgccauuguacuccagccugggc

SEQ ID NO: 55346 - RNA, 72 nt, Homo sapiens
gcugcauaggaucuguguggacacuucagucuucucucccacuugcuggccccuccccgggucuagugcagc

SEQ ID NO: 55347 - RNA, 75 nt, Homo sapiens
gcugccuuuuccccgauuuaaaccuuaucacaguccuuggagggugagauaaggaaauugaggcucagggacagc

SEQ ID NO: 55348 - RNA, 73 nt, Homo sapiens
gcuggccauggcccugggcugggcgaacaugcucuacuauacgcgggguuuccaguccaugggcauguacagc

SEQ ID NO: 55349 - RNA, 75 nt, Homo sapiens
gcugggaaacguucaugcagacacacauggaacucaauuagacugggucagugugauaucugcaggggcucuagu

SEQ ID NO: 55350 - RNA, 74 nt, Homo sapiens
gcuggaugcuucuuggcgaucauggcaguagccuccugaaugauagucuugagaagcauuuugacuaacccagu

SEQ ID NO: 55351 - RNA, 77 nt, Homo sapiens
gcuggcaaaugugguguuugagcugccagggaucaucagggucucucugcagcccgggacacugcauauauucuagc

SEQ ID NO: 55352 - RNA, 107 nt, Homo sapiens
gcugggggcuccugggcugugcauggagaaggggacugauucagagacaccaacaacucacaccuggacgugcucccaucuccaccugugcgcccaccucccucagc

SEQ ID NO: 55353 - RNA, 55 nt, Homo sapiens
gcugggaggcuguuggggugaucuaagcaagagauuauaacaguuuggacccagu

SEQ ID NO: 55354 - RNA, 76 nt, Homo sapiens
gcgucacagugaaugucaucauugccuagcgacuguuccuccggcuuggcagagaaggagacauucaugaagaugu

SEQ ID NO: 55355 - RNA, 82 nt, Homo sapiens
gcgggaaaaucugacagucucauugauuugcucucuuugccaucaccacucuugagaggaagaaaugugacuucaaacuugc

SEQ ID NO: 55356 - RNA, 89 nt, Homo sapiens
gcgggaacaucaggauggauggacagacacuggccuucuggaagguucaacuccagcagggaagcugugcuguuucacaaauuggcugc

SEQ ID NO: 55357 - RNA, 98 nt, Homo sapiens
gcgaucacggguuuuggcagugcccgaugcuggggcuugggucugaugugaccccgauuccuucuccagugcgggacucccgccgcccuaacuuucgc

SEQ ID NO: 55358 - RNA, 63 nt, Homo sapiens
gcgaaugugggaguccacugcccggcagauggagagagccucugcggguguggacccuagugc

SEQ ID NO: 55359 - RNA, 125 nt, Homo sapiens
gccuuccaaagugcugggauuacaggcaugagccacugcacuuauccuccaauguuuuaauaaauaauaaagcauuuaggccggaugcagugucucaugccuguaaucccagcacuuugggaggc

SEQ ID NO: 55360 - RNA, 77 nt, Homo sapiens
gccuuguaguauaguuugaagucagguagcaugaugccuccagcuuuguucuuuuggcuuaagauugacugcaaggc

SEQ ID NO: 55361 - RNA, 89 nt, Homo sapiens
gccuuugguuuggaauccuuguagccacaaguggugaggaaguuuaaaagcgcuuugguggcuugauggcacaagguuucugaaugggc

SEQ ID NO: 55362 - RNA, 91 nt, Homo sapiens
gccuuuguuucuucaucugucaugugaggauaacaauagugcccaucuuguagggugguugugagacuuaaaugagaugauggagcugggc

SEQ ID NO: 55363 - RNA, 82 nt, Homo sapiens
gccuuuuacgcacacugcaguaaauugcgucgguucauuuacucacagaacaagcacagacaaugcugcaguuuagaaaggu

SEQ ID NO: 55364 - RNA, 63 nt, Homo sapiens
gccuuuuuuauguugagauauauucuuuccauacuuuguugaguguuuuuaacaagaaagggu

SEQ ID NO: 55365 - RNA, 88 nt, Homo sapiens
gccugugcgcauguguggguuugugugagugcccauguaugcacacguguauaugcauguacccacacaggcccaucuccucacaggc

SEQ ID NO: 55366 - RNA, 62 nt, Homo sapiens
gccuggagugcuggaaggaguuuucuagguuuucuuguucuacccucuaguuuucaacaggc

SEQ ID NO: 55367 - RNA, 80 nt, Homo sapiens
uaaguggugugacucauagcucucaguuuuugguagacagcugaagccagagaacauucagagcuguagacaaacacuua

SEQ ID NO: 55368 - RNA, 73 nt, Homo sapiens
uaaguuaauguuuaagacuccuauuacuaauaauaauugaaacaguaauaggaguaguaguagcauuaauuua

SEQ ID NO: 55369 - RNA, 86 nt, Homo sapiens
uaaguucuaggguacacgugcacaauaugcagguuuguuacauauguauacaucugccauguuggugugcugcacccauuaacuug

SEQ ID NO: 55370 - RNA, 86 nt, Homo sapiens
uaaguucuaggguacaugugcacaacaugcagguuuguuacauauguauacaugcgccauguuggugugcuguacccauuaacuug

SEQ ID NO: 55371 - RNA, 86 nt, Homo sapiens
uaaguucuaggguacaugugcacaacgugcaaguuuguuacauauguauacaugcgccauguuggugugcugcacccguuaacuug

SEQ ID NO: 55372 - RNA, 86 nt, Homo sapiens
uaaguucuaggguacaugugcacaacgugcagguuuguuacauauguauacaugcgccauguuggugugcugcacccauuaacuug

SEQ ID NO: 55373 - RNA, 86 nt, Homo sapiens
uaaguuuuaggguacauguguacaacgugcaguuuuguuacauauguauacaagugccauguuggugugcugcacccauuaacuug

SEQ ID NO: 55374 - RNA, 67 nt, Homo sapiens
uaauaacuaugugaggugcugaauauguuaauuacuuugauugacauaaucauuucacaguguauua

SEQ ID NO: 55375 - RNA, 73 nt, Homo sapiens
uaacucacaguuuguuguuuuuauuucucacuucccuggugagaggugaaggucucaauaaauaaguaaguug

SEQ ID NO: 55376 - RNA, 82 nt, Homo sapiens
uaagagacuuaagcauccguggauuuugguaacugaggguggauccuagaaccaaucccacauggauacuuaucauuucuua

SEQ ID NO: 55377 - RNA, 79 nt, Homo sapiens
uaagagaguuaaagaauaagaaacaaagucuguauauuuacccauacaguugccauuucuugugcuugucauuuucuua

SEQ ID NO: 55378 - RNA, 107 nt, Homo sapiens
uaagcacucauuuugguugaguucauaugcaggagcggaauuucuucgucauagaaugaaauguauguuuggcuuuuguaauaacugccaaagugauuauguguuua

SEQ ID NO: 55379 - RNA, 89 nt, Homo sapiens
uaagcucuaugagaacaggaauuucuguugguguugugcauugcuauaucaccagcaccaauaacaguuucuagcauauacuaggcuua

SEQ ID NO: 55380 - RNA, 63 nt, Homo sapiens
uaaggaggcugcugugaagaaaggacaugcaauuccuccugccaucacacuguggcuucuuua

SEQ ID NO: 55381 - RNA, 81 nt, Homo sapiens
uaaggugacuaaagugaggauggcaguagguuuggauuccuuauuuacuuacuucuaguuugucacuucucagucaccuug

SEQ ID NO: 55382 - RNA, 75 nt, Homo sapiens
uaagguugaaagcuacaggaaaguauuuucacuaacaaagggugaaaauaauguaaguauuuuuaaaaacccuug

SEQ ID NO: 55383 - RNA, 60 nt, Homo sapiens
uaagugaaggaaguguguuuacaaaugucauuuuugucugauuucacuuaccuucauuua

SEQ ID NO: 55384 - RNA, 55 nt, Homo sapiens
uaagugaauauggacaguuagcauuuagcaacauguaucugucuacuuucucuug

SEQ ID NO: 55385 - RNA, 64 nt, Homo sapiens
uaaauaacucucguuuaugccuaguguuccauuauuggaaugcuaagcaugugggaauuauuug

SEQ ID NO: 55386 - RNA, 82 nt, Homo sapiens
uaaagauuagagaugaguuagguaauaauaaauaugguauuuuuucuagauuugguagcauuuaacagguuucucagcuuua

SEQ ID NO: 55387 - RNA, 75 nt, Homo sapiens
guuuuagacuauuuuguuuccuugucauuucaauggaauuuggaagagaagggagauaaacauauauguuuaggc

SEQ ID NO: 55388 - RNA, 65 nt, Homo sapiens
guuuuaggguacaugugcacauugugcagguuaguuacauaugaguacaugugccaugcuggagc

SEQ ID NO: 55389 - RNA, 68 nt, Homo sapiens
uaaauaguagcugaaugagggaacagaguugcaaauguuuucccuguuugucauuuaucuuuuguuua

SEQ ID NO: 55390 - RNA, 79 nt, Homo sapiens
uaaaugcuuaauugaauguggaacucaacugugcauuaucuaugcagauguaauauuguucacguuuguugaguauuua

SEQ ID NO: 55391 - RNA, 94 nt, Homo sapiens
uaaaugucauuucuuuaaggaucaaaagugugaauaauaaguaaauauguuuuuucaagcuauggugaucuuuuccaagggauggugauauuua

SEQ ID NO: 55392 - RNA, 119 nt, Homo sapiens
uaaauuccuuuaauagauauagggauacucugguuauauauuucuucaugaguaaucuuugguaguugaugucuuucauggaauauugaccauuuuaucuaaguuguugagcuuauuua

SEQ ID NO: 55393 - RNA, 68 nt, Homo sapiens
uaacaaaugcaccacucuggugcaggauguugauaguaacaaaugcaccacucuggugcaggauguug

SEQ ID NO: 55394 - RNA, 69 nt, Homo sapiens
uaacaaggaaacaacuauaauucauuuuaauaaggugcuuguuaaauacagcaugguguuucuguguug

SEQ ID NO: 55395 - RNA, 89 nt, Homo sapiens
uaacaggugugaaguaauguuuuauucuauuuuguauuugaauuucucuggugauuaaugauauugaacaucuuuucauauaccuguug

SEQ ID NO: 55396 - RNA, 59 nt, Homo sapiens
uaacauagucauauacuugcuugaguuuucacauagggcacaggaaaugacucauguua

SEQ ID NO: 55397 - RNA, 70 nt, Homo sapiens
uaccugcagagaaacauuuuguauuuucaauaaauggugcuggaaaaacugaaauauuucucuguaggua

SEQ ID NO: 55398 - RNA, 78 nt, Homo sapiens
uacucuugucacuguuuccuauuauauuugggugauucaguauaacagaagaauguaauaggaaacguguggagggug

SEQ ID NO: 55399 - RNA, 82 nt, Homo sapiens
uacugguuugaguucuuuguagauucuguguauuaguccuuugucagaugcagacuuugcaaagauuuucuccugcucugug

SEQ ID NO: 55400 - RNA, 78 nt, Homo sapiens
uaaucacuucuagcuuuugauguaaagugagagacaugcaacucuucacuugaaugcuuagaggccacuguaggauua

SEQ ID NO: 55401 - RNA, 72 nt, Homo sapiens
uaaucagucuaauagcauuuauuggcugcuuaccaaguucuggacacugaucuaagugcuuuauauugauua

SEQ ID NO: 55402 - RNA, 78 nt, Homo sapiens
uaccauagguaaugaaugcuaccagcaucuaguggguaguagugagagcccagggaugcugcuuagcauccuacggua

SEQ ID NO: 55403 - RNA, 86 nt, Homo sapiens
uacccagaaagacacauggccucccgcauuugccguuuaucucugcagacaggaaagcuagguguggguguacuguggaucgggug

SEQ ID NO: 55404 - RNA, 59 nt, Homo sapiens
uaauguuaguuuuccauacaugguuaucuuuuaaggauagcaguaagaaacugacauug

SEQ ID NO: 55405 - RNA, 74 nt, Homo sapiens
uaauuaugguuucauuaugaugcaccauaucagggcuguuguaaugucaugucugcacauaguaaaaauaguua

SEQ ID NO: 55406 - RNA, 66 nt, Homo sapiens
uaauucuauuagugccuaagucuuaggggcugacaauuaggcucuaagggaggcauaguauaauua

SEQ ID NO: 55407 - RNA, 78 nt, Homo sapiens
uaauuuaaugucaggcaccgauacaguuuuuugugguuguucagaaacgagaaaggugugugguucugaagugaauua

SEQ ID NO: 55408 - RNA, 73 nt, Homo sapiens
uaauuuugauguguugggaagauuucaaguccucucuccuggcuauuuugaaauacaccauacauuguuguua

SEQ ID NO: 55409 - RNA, 67 nt, Homo sapiens
uaauuuugucauuuucagaguguuacgugaaucuuucaguauguaaccuuuuggaauuggcguguua

SEQ ID NO: 55410 - RNA, 82 nt, Homo sapiens
uacaaagaagcugugauuauccacgucuuugugaaugagaaagugacauucaacggacuuacuggagaugauggaauuugug

SEQ ID NO: 55411 - RNA, 88 nt, Homo sapiens
uacacagaaaguguucacagugguugccuuccagaagaacuuugaacuuuuggaaauguuuaaaucaugugcaugaaugaucugugua

SEQ ID NO: 55412 - RNA, 76 nt, Homo sapiens
uacagguacaaugugcacuauuagggugauaguuacacuaaaagcccagacuucaccacugcacaauguaccugug

SEQ ID NO: 55413 - RNA, 63 nt, Homo sapiens
uacaguaaauuucugugcuuucauagagaaaagauauugugggggcacugggaauuuauggug

SEQ ID NO: 55414 - RNA, 56 nt, Homo sapiens
uacagucacauuccugaccauacaucgugaaaauuguguguguguguguguuugug

SEQ ID NO: 55415 - RNA, 69 nt, Homo sapiens
uacagucauaaugccuagugacagagauacguucugagaaaugcaucacuaggugauuuugucauugug

SEQ ID NO: 55416 - RNA, 76 nt, Homo sapiens
uacauaagugcaugauuacaugcauaugcauauaaacaugcagccaugcauauguaugaaugaaugcauaggugug

SEQ ID NO: 55417 - RNA, 63 nt, Homo sapiens
uacauauaaggagacuagggcauagagaagucgaacgacaugcccaaguuuuccuaaugagua

SEQ ID NO: 55418 - RNA, 65 nt, Homo sapiens
uacauauauaagguagaaauagucacaucuguaaugcagugguccugguccccuuuauguaugug

SEQ ID NO: 55419 - RNA, 83 nt, Homo sapiens
uacaucuguauauguuuucauaaggcuagaaggacuuuaaaauauuaucugauuuauuguuguggauagcaugugcuugagug

SEQ ID NO: 55420 - RNA, 57 nt, Homo sapiens
uacauggguggugggaucuguaccucaaaccgcagcauugcacaauauacccaugua

SEQ ID NO: 55421 - RNA, 67 nt, Homo sapiens
uaccaaguauuuucacaugaacaggguagguuuuauauuaacccauuuuucauaugaagaacuggua

SEQ ID NO: 55422 - RNA, 73 nt, Homo sapiens
guugcuuuugcuugaggucuagcuacccuguauagccauguagaacgggaaguacccucaggcaaaaagcagc

SEQ ID NO: 55423 - RNA, 57 nt, Homo sapiens
guuggaacacaaaagagauccuucaaggauuuuacagucuuuugugugagucccaac

SEQ ID NO: 55424 - RNA, 55 nt, Homo sapiens
guuggaauuacaggccugagccacugcgacuggccccauggcuuauaauuuuaau

SEQ ID NO: 55425 - RNA, 60 nt, Homo sapiens
guugggcugaagugugugcuuauaaauguguuuaguuuuuaagcuaaacauucaguuaac

SEQ ID NO: 55426 - RNA, 63 nt, Homo sapiens
guugccuaggcuggagugcaguggcgcgaucucggcucacugcaaccuccgccucccagguuc

SEQ ID NO: 55427 - RNA, 127 nt, Homo sapiens
guugcuagauuuugaaaaguuaggguuuuucucccuauaaaguuaagacagaauguuaagauugcugguauuaauacugcuuaacuuuaggaaaggaauuauaucacccuccaguucuuucuguaac

SEQ ID NO: 55428 - RNA, 70 nt, Homo sapiens
guugcucaggccggagugcaguggcacgaucuugguucauugcaaccuccaccuccuggauuugagcgau

SEQ ID NO: 55429 - RNA, 78 nt, Homo sapiens
guuguacacacuggugaauuuuuauuuaagugacucacuauugaugugacuugugaaaaguucagcauaguuggcaau

SEQ ID NO: 55430 - RNA, 86 nt, Homo sapiens
guuguagcaguguacaccuguggucccaguaacuuggcaagcugaagugaaaggauugcuugaaccuaggaguucaaggcugcaau

SEQ ID NO: 55431 - RNA, 74 nt, Homo sapiens
guuguauguggauuuuucaacugcauggggguugacaccccuaaucccuguguuguucaaggaucugcuauaau

SEQ ID NO: 55432 - RNA, 57 nt, Homo sapiens
guugugaacacagaggcuauggcacggcuucccgugcaagcuucaugguuuacugac

SEQ ID NO: 55433 - RNA, 64 nt, Homo sapiens
guugugaauagugccgcaauaaacaugcgugugcaugugucuuuauagcagcacgauuuauaau

SEQ ID NO: 55434 - RNA, 99 nt, Homo sapiens
guuuaagauuuaguaagacagucauugcauguuaauuaaacagcaauggaucauuuaccaaccuguuuaaugagguguaacaacuauugaauauaaaac

SEQ ID NO: 55435 - RNA, 65 nt, Homo sapiens
guuuagcuuauaucugcagugugaccccagucagguuccaccuauauuugcaauuuaagcuagau

SEQ ID NO: 55436 - RNA, 60 nt, Homo sapiens
guuuugaccuucuaaagugcuguuacuuugccuaaaauggaaguauggaggaggcagaau

SEQ ID NO: 55437 - RNA, 120 nt, Homo sapiens
guuuuuaauauggucaauaguauuaaagcuuggaagccuagauucuuuucuuuugaccccaaguggaaaagaaagucuuccuuguuuguuugcuuuuuuuuuccuugugacugugaaagc

SEQ ID NO: 55438 - RNA, 61 nt, Homo sapiens
guuuuuaguccucugaaaaucuauaauauucuauaauugagagaucggagggauuaaaaau

SEQ ID NO: 55439 - RNA, 59 nt, Homo sapiens
guuuuugggaaggaggagaauuauauguauauagagcugauaucuuuauucccaagagc

SEQ ID NO: 55440 - RNA, 63 nt, Homo sapiens
guuuuuggggucacuauuaccgaaaggguuugacgggccccugaggugauguaccuuaaaaac

SEQ ID NO: 55441 - RNA, 89 nt, Homo sapiens
guuuuuugguagcauuuuuugcuuuauucugcucgugcauauuuuggaaugaggugaguaaauaaaugaaugaacaaacaaauaagaac

SEQ ID NO: 55442 - RNA, 72 nt, Homo sapiens
uaaaaugacauugauaguuuaauaggaauugcauuaaaucuguagauugcuuuggacugucuggccauuuug

SEQ ID NO: 55443 - RNA, 92 nt, Homo sapiens
guuuccuagcuagcaauuucuuggggcaauggaauaggugauugaaagaaugucuaacauucacaugcugcaaaaaugguuaacggggaaau

SEQ ID NO: 55444 - RNA, 106 nt, Homo sapiens
guuuccucauuuguugagugagauaucuagacuagggaaaucuuaaagcuaacagccuucaguucccguguuuuaucuuccaacaucagcaacaaaaacaggaagc

SEQ ID NO: 55445 - RNA, 56 nt, Homo sapiens
guuugucaucaucaucaucaucauaucacuuuuuagggcagugagagaugacaaac

SEQ ID NO: 55446 - RNA, 56 nt, Homo sapiens
guuugucccuuugcaguggcacacagggagcuauguguccacaagaggagacgaac

SEQ ID NO: 55447 - RNA, 74 nt, Homo sapiens
guuuguuuugagacugagucuugcuuugucaccuaagcuggagugccauggcacgaucucaguccacugcaaac

SEQ ID NO: 55448 - RNA, 73 nt, Homo sapiens
guuuguuuugagaugagucucgcucugucacccaugcuggagugcaguggcacgaucucggcucacugcaaac

SEQ ID NO: 55449 - RNA, 98 nt, Homo sapiens
guuucugauucagcagaccaagguugagguuugcauuucuaacauuuguauuucuguuagaacauuccaggugauguuggagcugcugauucagagac

SEQ ID NO: 55450 - RNA, 77 nt, Homo sapiens
guuucuggcauacaguagcuacucaauaacuauuucuggaauaaauaagugaauguuggcuacugaacacuagagac

SEQ ID NO: 55451 - RNA, 125 nt, Homo sapiens
guuugaauguacauuuuuaaaguucuucaauucaugagugguuuuuuucugccuuauagccaguccccacuauauuucagcuagauuuagcaaaagaucagucauugaaagaauacauuucagau

SEQ ID NO: 55452 - RNA, 95 nt, Homo sapiens
guuugaggcugcagugaguuaugauggcaccacugcacuccaaucuggggagcugcagugcaauggugccaucauagcucacugcagccucgaac

SEQ ID NO: 55453 - RNA, 73 nt, Homo sapiens
guuugauauguaacuacuccuuauaugccauuuuauuuugugcauacaugugauuguaguauacauauuaggu

SEQ ID NO: 55454 - RNA, 69 nt, Homo sapiens
guuugcaacauaguccuauguagugauuuuaaugauaucgcauacuuuacacauggauuuugugcaaac

SEQ ID NO: 55455 - RNA, 62 nt, Homo sapiens
guuugcauaagugcauucugugauguucacacgaugaaaucacgugaugcauuugucagaac

SEQ ID NO: 55456 - RNA, 57 nt, Homo sapiens
guuugccuuuuagauaggaaugcugaaaauaaugagacacuucugucuggaggaaac

SEQ ID NO: 55457 - RNA, 77 nt, Homo sapiens
guuuggaaaccuguagccacagguggcgaggaaauuaaagagugcuuggguggcuugauggcacaagguuucugaac

SEQ ID NO: 55458 - RNA, 78 nt, Homo sapiens
guuuggaaaccuuguagccacagguggcuaggaaauuuaagagugcuuggguggcuugauggcacaagguuucugaau

SEQ ID NO: 55459 - RNA, 78 nt, Homo sapiens
guuuggaaacuuuguagccacagguggugaggaaauuuaacagcgcuuguauggcuugauggcacaagguuucugaau

SEQ ID NO: 55460 - RNA, 124 nt, Homo sapiens
guuuauaugcugauaucaacucugcccugguugauuuuuauucuaggguauuugcagaguucccacuuucaaaugcacguagagaaaauaauccccaucaggacaucuggcauuguuuuuaaac

SEQ ID NO: 55461 - RNA, 67 nt, Homo sapiens
guuuauuacaguagaugaggguauaaugguacaagcugucacaauaccauucauuuacucaacagac

SEQ ID NO: 55462 - RNA, 62 nt, Homo sapiens
guuuauucuucaagaaccuagcugaccaagugguacacaugauaagugcuugaugaaugaac

SEQ ID NO: 55463 - RNA, 90 nt, Homo sapiens
guuucacaguaggucugccccgggugaugcagccgucagucgggggccccugugugaagcggccgucauccggggaccccugugugaagc

SEQ ID NO: 55464 - RNA, 55 nt, Homo sapiens
guuucaggcaccauggucauugauaacaucuuaucaggagacaggguuuugagau

SEQ ID NO: 55465 - RNA, 55 nt, Homo sapiens
guuucaggcaccauugucauugauaacaucuuaucaggagacaggguuuugagau

SEQ ID NO: 55466 - RNA, 56 nt, Homo sapiens
guuucaggcaccauugucauugauaacaucuuaucaggagacaggguuuuugagau

SEQ ID NO: 55467 - RNA, 86 nt, Homo sapiens
guuucagguaaaugauauuuuauguaaguacaccgcaaauauugcauggauauacuuguacuucaagauuaugguuuaucugaaau

SEQ ID NO: 55468 - RNA, 84 nt, Homo sapiens
ucaaggaaaugaguaguugcuaaauauugaguuaauauguuauacauuccuucucagugauuacagaauacuuauaucaaauga

SEQ ID NO: 55469 - RNA, 77 nt, Homo sapiens
uauucacaagaguuucacugcaaacugacuuuucagggcaaauucaccacccaaaagucuguagugaaaggugaaug

SEQ ID NO: 55470 - RNA, 86 nt, Homo sapiens
uauucauuaaauuccuuccaguugugagcuauccgggcuuuaagggaccugaagcucaaaugacuuggggaggcuuuuaaggaaua

SEQ ID NO: 55471 - RNA, 66 nt, Homo sapiens
ucaaaccauauaaucgguuacacuacaauucaaaacaaauuagggugaaagacauauaugguuuga

SEQ ID NO: 55472 - RNA, 106 nt, Homo sapiens
ucaaacgugucauucuuucccucuguggcuaagacaaccuuuccugucucccaagauuacaugaaagguugucuuaagccauagagggaaagaaugacauguuuga

SEQ ID NO: 55473 - RNA, 99 nt, Homo sapiens
ucaaauaggaaaagauuuuagucuuuucaguuugucaggauguaauaaaaaugcaaugaauagacacuaaagacuguauuuuuuaaaucuuuuuuuuga

SEQ ID NO: 55474 - RNA, 58 nt, Homo sapiens
ucacaguucagcauggcugaggaguccucaggaaacuuacaaucauggcugaacguga

SEQ ID NO: 55475 - RNA, 71 nt, Homo sapiens
ucaaguagcagaacauguuccuuguaaaugcuaaaccauaacagcuauagaucaugugucugcccuuuuga

SEQ ID NO: 55476 - RNA, 93 nt, Homo sapiens
ucacacuaucacacccaggcuagagugcagguguaugguuacagcucacuguugauugcacaccugcacucaagccaugaugugacagaguga

SEQ ID NO: 55477 - RNA, 56 nt, Homo sapiens
ucacacuguuuugauuauuauaacucuguauuaaguuuugaaaucaggaaguguga

SEQ ID NO: 55478 - RNA, 66 nt, Homo sapiens
ucacaggguguuauuagaauuaaaucaaauaaugaauuaucacagugcucuguaacauccuguuga

SEQ ID NO: 55479 - RNA, 60 nt, Homo sapiens
ucaccaauacuuauuaucuuuugucuuuuugauaacagccaucugauaagugugagguga

SEQ ID NO: 55480 - RNA, 62 nt, Homo sapiens
ucacgauacuauucucauucuccauaucuuacuggauuuuggaggacaagcauggauaguga

SEQ ID NO: 55481 - RNA, 129 nt, Homo sapiens
ucacauuuuauacacuguuagggcugaacugugucuccugaaaauucacauguugaaacccaaagccauaccucagaaugugacuuauuaggagacacagccuccaaagacgugauuaaguaaaaguga

SEQ ID NO: 55482 - RNA, 62 nt, Homo sapiens
ucaccauuucaagugcugucuuagcugugacugguuuucagugacacuaaccacuuggguga

SEQ ID NO: 55483 - RNA, 70 nt, Homo sapiens
uauuuguuagugaaugcaccacuucugacuacugcuccaagggguuagauggauaauucuuuaggaagug

SEQ ID NO: 55484 - RNA, 120 nt, Homo sapiens
uauuuuagagacagggucucacucuguugccuaggcuggauugcaguggugcuaucauagcucacugcagccuccagcuccugggcucaagugauccucccaccuuggccuccuaaagug

SEQ ID NO: 55485 - RNA, 72 nt, Homo sapiens
uauuuuccuuuuauacucgucugaaugauucuuugaaagagaauguuuucaugagaaugaauaggggaaaua

SEQ ID NO: 55486 - RNA, 58 nt, Homo sapiens
uauuuucuuuaaagguuaaaucauaguuauugcuaugauaaguuauuagaagaagaug

SEQ ID NO: 55487 - RNA, 88 nt, Homo sapiens
uauuuuuugaggaugucaacaaaauuauucuaaguccuuuguggauuggcaaaggaacuggaauauuuugaacaauuuuuaaaaagug

SEQ ID NO: 55488 - RNA, 66 nt, Homo sapiens
uauuucuaguucuagauccuugaggaaucaccacacugucuuccacaaugguugaacuaguuuaua

SEQ ID NO: 55489 - RNA, 55 nt, Homo sapiens
uauuucuuucuugauauuuuggcugcucauaaugucaguuacugagagagaagug

SEQ ID NO: 55490 - RNA, 58 nt, Homo sapiens
uauuuggaaacaauucacaugcuuuuucugucuuuguaggcaugugaauguucaaaua

SEQ ID NO: 55491 - RNA, 84 nt, Homo sapiens
uauuuauauuuguauuaacuaucuccacagaagucauuugcaacaaauugaauggaacuggagaugguuauauuaaguaaaaua

SEQ ID NO: 55492 - RNA, 55 nt, Homo sapiens
uauuucaguugcguuucccgaguagccccagcaacaggagaagcaucuagaaaua

SEQ ID NO: 55493 - RNA, 65 nt, Homo sapiens
uauuucaguugugcagguaguuugcauuuuaaaucaucucacacaacuugcuggaaacugaaaug

SEQ ID NO: 55494 - RNA, 86 nt, Homo sapiens
uauucuacugucuaugucuuggaaaguuguuguaguuauuauuuuugauuaguacaugauugaaucuuucuaugaagauaagagua

SEQ ID NO: 55495 - RNA, 80 nt, Homo sapiens
uauucuguaugauacuguaacagugggugugccucaugacacauuagugaaaacccagugaauguacagcauaaagagug

SEQ ID NO: 55496 - RNA, 55 nt, Homo sapiens
uauugaacgugggauauugaagucucuaagagacuucaauaucccacguucaaua

SEQ ID NO: 55497 - RNA, 58 nt, Homo sapiens
uauugcacuccucaugcauuuggugauccuugacugugugcauuuuugaguugcaaug

SEQ ID NO: 55498 - RNA, 62 nt, Homo sapiens
uauugcagugagauccaucuggugaaguaagaaaacauuuggugaaaaugucaccugcaaua

SEQ ID NO: 55499 - RNA, 55 nt, Homo sapiens
uauguucaucuugugcucaguaaauuugcacuuugccuaguagaaggugaacaug

SEQ ID NO: 55500 - RNA, 88 nt, Homo sapiens
uauguugaauagaaguguugaaaguggacauccuugucuuguuccaguucucagggggaaugcuuucaacuuuuccuuguucaauaua

SEQ ID NO: 55501 - RNA, 122 nt, Homo sapiens
uauuaauugcacugugguuuaguaagggaauaagaugauguucuuuuucuuaggagaucuaugaugaaguauuuuaagguaaaggaacaucauaucuacaaccuacucccaguaguauagua

SEQ ID NO: 55502 - RNA, 77 nt, Homo sapiens
uauuagguuggugcaaaaguaauugugguuuuugccauuauuuucaaagcugcauuuacuuuugcacaaaccugaua

SEQ ID NO: 55503 - RNA, 84 nt, Homo sapiens
uauuagguugguggaaaaguaguugcgguuuuugccauuaaaaguaaugaccaaaaucgcaauuauuuuugcaccaacuuaaua

SEQ ID NO: 55504 - RNA, 121 nt, Homo sapiens
uauuauauaucccugaaaucuaaaguggauaacacauguggagagagaaugacuuaucugauuaaaagaaugaugucauuuuaauuucuaaucaauguguugguuacuaggauguauagua

SEQ ID NO: 55505 - RNA, 56 nt, Homo sapiens
uaugccuuuuggcucaagaaacauugccauauauguugcuugaaccaaaaggcaua

SEQ ID NO: 55506 - RNA, 77 nt, Homo sapiens
uaucuagccuaugaagcuuguccagccuagaagauauuaagaugggcauuaauguacucauuucauaggguuaggug

SEQ ID NO: 55507 - RNA, 62 nt, Homo sapiens
uaucucauccuccuugaucccauccccaucaaaacuagagauugaaauaaggagaugagaug

SEQ ID NO: 55508 - RNA, 62 nt, Homo sapiens
uaugcuguuuuguagcucccucuuuucacuaacccacuacaagauggggcaagaagagcaua

SEQ ID NO: 55509 - RNA, 60 nt, Homo sapiens
uauggauuuuuuugacaagagcgucgaugcuuuccauuggguucuuaaaaaggaucuaug

SEQ ID NO: 55510 - RNA, 86 nt, Homo sapiens
uauggucucagaacugucauaaauugcacuggaaguaacugagcgcaugccagugugcgagaguguaauuggccuugagaacuaug

SEQ ID NO: 55511 - RNA, 58 nt, Homo sapiens
uauguaacaccguggucauagcauuuauaagauuguacugugauuauuuaguugcaug

SEQ ID NO: 55512 - RNA, 129 nt, Homo sapiens
uauguauaucaaauaguuauuccuuuuuauuacugacuagcauuccauuguauaacacaguuuguuuauccauucgccuguugauagacaucugaguuguugccuguuucuggcuguuuuaugaacaug

SEQ ID NO: 55513 - RNA, 76 nt, Homo sapiens
uaugucagagagaagauuuggugcucaaaggccgcuguucagauucuuuugucccauggggucuuccuuugaugua

SEQ ID NO: 55514 - RNA, 66 nt, Homo sapiens
uaugucaugggguuuuugagauaacuaaauuauuuacguaaguugcugaagacacugcauggcaua

SEQ ID NO: 55515 - RNA, 72 nt, Homo sapiens
uaggguaguacagagaguguccuaaagggccaagcacacaggugagauuaugacacuccugugcgcacccug

SEQ ID NO: 55516 - RNA, 58 nt, Homo sapiens
uaggucaguuuuggcuuggcuuggcugagauuggcuggguuugucuagacuggcucua

SEQ ID NO: 55517 - RNA, 74 nt, Homo sapiens
uagguugucuuucaggguuuuuauaguuuuagguuuuacauuuaagacuguaauccaucuugaguuaauuucug

SEQ ID NO: 55518 - RNA, 76 nt, Homo sapiens
uaguacuaauauaauagcaguguuacuaggacugauaccauuaguuauaguacuaguacugcuugcaguaguacua

SEQ ID NO: 55519 - RNA, 100 nt, Homo sapiens
uaggacaacauuucuuuuuguagcuuuugagauuuauauuucuguuggguguuaaaauuucaaaggugaguaacuauuuacaugagggccaauugguuua

SEQ ID NO: 55520 - RNA, 81 nt, Homo sapiens
uaggcauugaacuaucccuguucauggugauuuucagaauaagacugagaugugaucaccugaaggguguccuaaugcuua

SEQ ID NO: 55521 - RNA, 57 nt, Homo sapiens
uaggccaguauuuuauugagaauuuuuugcguugauguucaucaggauauuggucua

SEQ ID NO: 55522 - RNA, 71 nt, Homo sapiens
uagggaugagguaucauuauguugcccaggcuggucuugaacuccugggcucaagugauccucucgccuug

SEQ ID NO: 55523 - RNA, 96 nt, Homo sapiens
uagggcaauagcucagcagugcagcaucaaaucacacaagaugcuggucccuucugaaucuuguauuuugguagcuaugccugagcccuugccuua

SEQ ID NO: 55524 - RNA, 129 nt, Homo sapiens
uagucugcaccucaaagcguugcugugaagauuaaaugagcuaauauggguaaguugcuuaguucagcaccuccucaacucucauuguuaguucuugauagaaucaucaaugcgguaagaugcauacua

SEQ ID NO: 55525 - RNA, 83 nt, Homo sapiens
uagugguuccuuuuaguggacaaagguauuuagaaaccaagaucuagaugccaguuguguucacugcuacagggguaucacug

SEQ ID NO: 55526 - RNA, 75 nt, Homo sapiens
uaguuacagucacaauuuguaccuuuuucuccacuccaaacugagacuaagagggaaauuguuggcugcuaacug

SEQ ID NO: 55527 - RNA, 98 nt, Homo sapiens
uaguuggauuacugucacucauccauacuuacuguuaucaugcuuucucuuggugcuagauagcaggagaauggucaugggcauuugcggaucagcua

SEQ ID NO: 55528 - RNA, 77 nt, Homo sapiens
uaguuuacugagaaugaugauuuccaauuucauccaugucccuacaaaggaaaugaacucaucauuuuuuauggcug

SEQ ID NO: 55529 - RNA, 77 nt, Homo sapiens
uaguuuacugagaaugaugauuuccaguuucauccaggucccugcaaaggacaugagcucaucauuuuuuauggcug

SEQ ID NO: 55530 - RNA, 71 nt, Homo sapiens
uauacauguaauugauuuuguguuagccagucaugucauguuugacuaacacugaaaaugaugcaugugua

SEQ ID NO: 55531 - RNA, 72 nt, Homo sapiens
uauacuagucaagaauguaugaggaaacagaauucauucuucugggcauuuauaacauuucuuaccugugua

SEQ ID NO: 55532 - RNA, 70 nt, Homo sapiens
uauacugucuuuguaugccuagaagugcagcuaucucuuuguuaacacuaguuuuaugcaaggcaguaua

SEQ ID NO: 55533 - RNA, 125 nt, Homo sapiens
uauagcacucaaaacugucaagcuguaacagcaucacugugauuucuacugugcugagcagcagugugaagcaaggagagcaucacauauggucgcuguuguagcuacucagcuuagguguugua

SEQ ID NO: 55534 - RNA, 63 nt, Homo sapiens
uauagcagccugaacaaaguaaggaaaaugguaacauuuaguacuuuugacacaggcccuaug

SEQ ID NO: 55535 - RNA, 90 nt, Homo sapiens
uauagcuaccacaaauaacacuguuuccagucaugaucaggaaucacauauuaagacauaacugcaaauugugcuauacuggguacugua

SEQ ID NO: 55536 - RNA, 79 nt, Homo sapiens
uauauuaaucugguagucaucaaaguauaaaugauguuuaaaaccauaagacuauaugagauuacccagaaagaguaua

SEQ ID NO: 55537 - RNA, 60 nt, Homo sapiens
uauauucuggcuauagcaaaguaguuuaguugugaauauuauuugcauagugagaauaua

SEQ ID NO: 55538 - RNA, 66 nt, Homo sapiens
uaucacagugcuggaguauuccaugugugaaaucauuucauccucccaaugccuagcaaaguggua

SEQ ID NO: 55539 - RNA, 60 nt, Homo sapiens
uaucagagcugucagccuaccuauacagagaaaaaugguacaggcagagacagccuggua

SEQ ID NO: 55540 - RNA, 73 nt, Homo sapiens
uaucaucacuucuguucaaccguguacuggaaguccuagccaguaucacaggcaaaacagaauaagaaagaua

SEQ ID NO: 55541 - RNA, 74 nt, Homo sapiens
uauccaggaauuuauccauuucuucuagauuuucuaguuuauuuguguagagguauguauaguauucuuugaug

SEQ ID NO: 55542 - RNA, 56 nt, Homo sapiens
uaucuguucuuuaaaacuuugauagacgucuaugaaauuguuugcaaggauaggug

SEQ ID NO: 55543 - RNA, 76 nt, Homo sapiens
uaucuuggugaauauuuuauguaagcuugagaagaauguguguucugcuguuguuugaugaaguaaucuauagaua

SEQ ID NO: 55544 - RNA, 77 nt, Homo sapiens
uaucuuuuugauauguuguuggauucacuuagcuaguauuuuguuaaggauuuuagcauauauguucaucaaggaua

SEQ ID NO: 55545 - RNA, 55 nt, Homo sapiens
uaugaaagcuacuucucacaaucacagacuuuuggugugagaaggaucuuauaug

SEQ ID NO: 55546 - RNA, 130 nt, Homo sapiens
uaugaaaugcccacaacuaacaucacacucaauggugaaagacugaaagcuuuucuuuccucuaagauacagaacaaggaaaggaugcucacucuuaucacuguuaaucaacauaguacuggaagucaua

SEQ ID NO: 55547 - RNA, 60 nt, Homo sapiens
uaugacauaguccuuaacccuccuccccacccugggagcaaggaagagauuaugcccaug

SEQ ID NO: 55548 - RNA, 66 nt, Homo sapiens
uaugaugaaagauuuccugagcuagaaauauccuaugauuuucauagcaagagguguugaaucaua

SEQ ID NO: 55549 - RNA, 68 nt, Homo sapiens
uaugauguaggccauggguuucucauaaacggucuuuauuauguugaggaacuuuccuucuauacaua

SEQ ID NO: 55550 - RNA, 75 nt, Homo sapiens
uagaguuaaaccuggguuggagcccugcuucagucauuuacuagcaguguggccuuagacccggccucagcuuug

SEQ ID NO: 55551 - RNA, 72 nt, Homo sapiens
uacuuccaagacauacaacauucuacuacguggacgcuuuccacugaguggcaaugugauguccugaaagua

SEQ ID NO: 55552 - RNA, 69 nt, Homo sapiens
uacuugaaauguuuucccgaccuuggccaaaagcagguugaguuuuccauuggaaaacuuuucuaagua

SEQ ID NO: 55553 - RNA, 63 nt, Homo sapiens
uacuugaucaaugugguacuugaucaaugugauacucgaucaaugugguacuugaucaaugug

SEQ ID NO: 55554 - RNA, 79 nt, Homo sapiens
uacuuugaauacaguaucuucuggcaagcacuggggacugcagucgacaaugcugcugaauauaccugaguacauagua

SEQ ID NO: 55555 - RNA, 66 nt, Homo sapiens
uagaauacuauccaauugccacaagaaaugaacuagauguauauauggcaacauggauggauucug

SEQ ID NO: 55556 - RNA, 91 nt, Homo sapiens
uagaauccuuuguuuaucuuugaccuaugggaguuugacuacuaaaugccuugagguagucuccuuuggguuaaaucugguugguauucua

SEQ ID NO: 55557 - RNA, 66 nt, Homo sapiens
uagaaugccugguguuggccagaaaucucucccauuagagugacuggcaccauccaggugucucua

SEQ ID NO: 55558 - RNA, 109 nt, Homo sapiens
uagaauuagagauacguaagugcuaaagauagugacaugauuugggaucugcuguuuucugggcaaaaacagauccgugucuuguuuuucuuauuuauuuucccuucua

SEQ ID NO: 55559 - RNA, 59 nt, Homo sapiens
uagagacaaagauuugcagauuaggcuagcaaauagaauaaaacuguaacuuuguccug

SEQ ID NO: 55560 - RNA, 56 nt, Homo sapiens
uagagacagugaauuuuuauugcuaggucugucagguggugagaaugacuguucug

SEQ ID NO: 55561 - RNA, 55 nt, Homo sapiens
uagagcucaucuucuuuaaacuucucaugauaguucugaggaaauugagauucug

SEQ ID NO: 55562 - RNA, 80 nt, Homo sapiens
uagcuaggcuaucauauccuagauauaacuucuauuacuauguaagaaguaaagaacggauauuggaaggcaucuagcua

SEQ ID NO: 55563 - RNA, 129 nt, Homo sapiens
uagcuauacugguuuacacauaugagaaacgggagcuguuuagagccugaucaggaauauuugaaauuauuugaaaaaugacuagggcucuaaacagcucccauuucucacguauguaaaccagugcua

SEQ ID NO: 55564 - RNA, 85 nt, Homo sapiens
uagcuaugugacauuggaagauuacuuaguuuucucuuuuguaagaugaaaauaguaauaucuaccuuagaguguuauagaguua

SEQ ID NO: 55565 - RNA, 66 nt, Homo sapiens
uagcuguuaauauacaaaugguggaaaguauuauugccuaucacaguuuugaauauaaugcagcua

SEQ ID NO: 55566 - RNA, 94 nt, Homo sapiens
uagcccaugagagagguuuugcccucgagauaaacuguagcucuaaauuucuuuuaaguuguuagggggaaaaaaucuauuucaguacuugcua

SEQ ID NO: 55567 - RNA, 74 nt, Homo sapiens
uagccucacaaagugcuuaagauuacaggugugagccaccauaccuggccuauuauuacuauuuuuguaggcua

SEQ ID NO: 55568 - RNA, 82 nt, Homo sapiens
uagccuuugguuuaagggaauguuguagcugguuugaucuauccagaccacuguaacuuucucuacauaagcgauaagguug

SEQ ID NO: 55569 - RNA, 58 nt, Homo sapiens
uagcaguaaagaaugugauguugucagaggaaggaagguguugaauuuuuugcuguug

SEQ ID NO: 55570 - RNA, 58 nt, Homo sapiens
uagcaguagacagacuuuggcuacuguguguccauuuccaauuauugaucuacuguug

SEQ ID NO: 55571 - RNA, 55 nt, Homo sapiens
uagcaguauugaaagaugagggagcuacaucuuccuugacaucguugugcugcua

SEQ ID NO: 55572 - RNA, 76 nt, Homo sapiens
uagcauaaauuaauaggauuuaccaggaauaacagaugccucugucauucaggaaauucuaaguauuuaaaggcua

SEQ ID NO: 55573 - RNA, 63 nt, Homo sapiens
uccuacuguaaaguaaagcacaucaaggugaaguauuauauuguugcuuuacauuaucuggga

SEQ ID NO: 55574 - RNA, 73 nt, Homo sapiens
uccuacuuuaugauaucugcaaaucaaguauugccaagcuggacaacauauucacagguaucagagauuagga

SEQ ID NO: 55575 - RNA, 78 nt, Homo sapiens
uccuauuucacagagagaacucaaaccauuggcuagaaacuucuucaaaaucuggucugauuuuucaucuguugggga

SEQ ID NO: 55576 - RNA, 93 nt, Homo sapiens
uccucccaggauuucuuucuugugggugcccuuuuugcagcguaaaaaccccaggggaagagguagcagucacaaaagaaauccuagggagga

SEQ ID NO: 55577 - RNA, 59 nt, Homo sapiens
uccucugaaaucuagauugugaugcaauguauacguucucuaaaucagauuucugagga

SEQ ID NO: 55578 - RNA, 70 nt, Homo sapiens
uccucuugcuauuuguuuucaaugugucauucaguggugggcugaaauguuaaacaaguggcucugaggg

SEQ ID NO: 55579 - RNA, 129 nt, Homo sapiens
uccugaccucaggucaucugcccaccucggccucccaaagugcugggauuacaggugugagucacugcgccuggccaauaauccuagcacuuuggaagaccuaggcaggaggaucacuugaggccagga

SEQ ID NO: 55580 - RNA, 61 nt, Homo sapiens
uccugagaagcauaccagugucuguugaccuagcaacagaguguaggaauguauuccagga

SEQ ID NO: 55581 - RNA, 68 nt, Homo sapiens
uccugagagcagacccucuauaaaucacaggcaccuagaccccuguucucagggucugcguucaugga

SEQ ID NO: 55582 - RNA, 79 nt, Homo sapiens
uccugagguaaaacucaugaaaguguguggaaacuugaaguuuuuaacucucaaucuauuccacuuucauccucuagga

SEQ ID NO: 55583 - RNA, 81 nt, Homo sapiens
uccugugacgggcgagcuuuuggcccggguuauaccugaugcucacguauaagacgagcaaaaagcuuguuggucagagga

SEQ ID NO: 55584 - RNA, 58 nt, Homo sapiens
uccugugagauaauguguaccaggucaaauuuaauuuuggucaguuuucucacuagga

SEQ ID NO: 55585 - RNA, 67 nt, Homo sapiens
uccuggagagucauuuauaguauuuuggaaaacaagucuaaaacacaaauuuguguucucauuagga

SEQ ID NO: 55586 - RNA, 90 nt, Homo sapiens
uccuggucucugaauaggcucuccugcugucucuggucugcccaucccacucaccccugagacuugagggggcuucucugagagccagga

SEQ ID NO: 55587 - RNA, 96 nt, Homo sapiens
ucccagucauacuccugacacaguguuccagcuauuugaaucagacaggcacuucuuuucaucugcaggaaugcugauguccuguguagaauggga

SEQ ID NO: 55588 - RNA, 85 nt, Homo sapiens
ucccaguucuguggauugacuggaccagcugggguaguucucauuuggggucucucaaguggucgcaguuagauagcagcuggga

SEQ ID NO: 55589 - RNA, 59 nt, Homo sapiens
ucccaucgucuccuggaugauaugcaauguccugcagucacagggagauggugacagga

SEQ ID NO: 55590 - RNA, 87 nt, Homo sapiens
ucccuggagauguacgagagcauuaagccaucaucauucacccaugauacauuuaccuauggucuugaucggcucucccaucuugga

SEQ ID NO: 55591 - RNA, 59 nt, Homo sapiens
ucaugaagaucucugccuuguguccaagauucuuggacaaagcagcaguaucuuuauga

SEQ ID NO: 55592 - RNA, 82 nt, Homo sapiens
uccacguuuaugaaguacaguacugaaugaauguauggugcaguaaugaauauacaaaguacaguacaguaaugaaugugga

SEQ ID NO: 55593 - RNA, 69 nt, Homo sapiens
uccagaguuaugguuuccuguguaauaacuagugagauuacuggucacauuggacuaucaaguuuugga

SEQ ID NO: 55594 - RNA, 58 nt, Homo sapiens
uccagggguuaggggccugaagaucuggugucugauguuugcagagcccaacccugga

SEQ ID NO: 55595 - RNA, 59 nt, Homo sapiens
uccagugccagcuguuaaaguuucaucgucucaucgugaaagacacuguccccacugga

SEQ ID NO: 55596 - RNA, 106 nt, Homo sapiens
uccaucuguaaucuuaagagagaacugauuggaugugggcacguuccucagauucuaugcccaacuccaaucaguucucucucucuucccucggauuauagaugga

SEQ ID NO: 55597 - RNA, 90 nt, Homo sapiens
uccauggcaguugucacuuuggcuuuuacugucaugauguugagguucaugagguaguagaaagucaggugaagcacacugucaucugga

SEQ ID NO: 55598 - RNA, 73 nt, Homo sapiens
uccaugugaaaucuaugaggacagcagcaaacacgaaagccaacaugcauuuccuuccuuugauucacuuggg

SEQ ID NO: 55599 - RNA, 58 nt, Homo sapiens
uccauuuuaagagugccauuucacaaaguccauggaagagguaugacuaugaagugga

SEQ ID NO: 55600 - RNA, 88 nt, Homo sapiens
ucagaaucccauguagcuaggauuacagauguccaccuuccaccauacccggcuaauuuuuguauuuuuaguauagaugggguuuuga

SEQ ID NO: 55601 - RNA, 114 nt, Homo sapiens
ucagauggugaugcuauuggcugugauuaugguuaugauucaaguuggcaaugagacucgcaagaugcaauuggcuuguguuuacuguaguuacuguuuuaguucauuuucuga

SEQ ID NO: 55602 - RNA, 62 nt, Homo sapiens
ucagauuugucugugguugucaggcauguuaaugacauacagccauuccagccaaauacugg

SEQ ID NO: 55603 - RNA, 56 nt, Homo sapiens
ucaggcaugcagcaaugcagugacaguaacacaugcagauggaaggcauagccuga

SEQ ID NO: 55604 - RNA, 79 nt, Homo sapiens
ucaggauuucauuaguuuucacuuacagaauuaauuuuaggucacugggaugcuguaugugagaaauaauaaguuuuga

SEQ ID NO: 55605 - RNA, 90 nt, Homo sapiens
ucagcggauaggugcuauuuaaggccaugcuauuagaugaggccacucagagaucuagaaagcaugaccuucagauaacacagucucuga

SEQ ID NO: 55606 - RNA, 81 nt, Homo sapiens
ucaggaggacaauauggagacugaucccucuuuccucuccucugaggaggucgaggaagcucucagcucucuuuccccuga

SEQ ID NO: 55607 - RNA, 68 nt, Homo sapiens
ucacgggaaaauuauugccaucauaaucuugucucauaugguuacucaaggcaauacuuucuuguugg

SEQ ID NO: 55608 - RNA, 55 nt, Homo sapiens
ucacucagaccuggugauaugccaaagagaaagaggcaucacacauuucugaugg

SEQ ID NO: 55609 - RNA, 81 nt, Homo sapiens
ucacucauucauucccugagcaucuguugagcccuugcuuugugcugggcuuugagcuaguugcuggggguacaaugguga

SEQ ID NO: 55610 - RNA, 129 nt, Homo sapiens
ucacugugggaccuuagaccagacacuucaccucucugagcuucaguuuccccucuguaaagggagggcaaaauugcaguuaggaugaugguuuaucuguagccugguuucuucccuugcacacugugg

SEQ ID NO: 55611 - RNA, 55 nt, Homo sapiens
ucacugugggcuuugaauccuguaaguaauuuaaaggcucaaaugcucccaguga

SEQ ID NO: 55612 - RNA, 58 nt, Homo sapiens
ucacugugugucucuguaucugaaucucuuuucccuggucuuacaaagacaccaguga

SEQ ID NO: 55613 - RNA, 71 nt, Homo sapiens
ucacuucuucugugauucuucaguuacuucaggccaucuggauguauacaugcaggucacaggggauauga

SEQ ID NO: 55614 - RNA, 76 nt, Homo sapiens
ucacuugaacccaggagguggagguugcaguaaguagagauugugccacugcacuccaccuugggcaacagaguga

SEQ ID NO: 55615 - RNA, 77 nt, Homo sapiens
ucacuugaaccucggagguggagauugcagugagccaagauagugccauugcacuccagcccuggcaacaagaguga

SEQ ID NO: 55616 - RNA, 76 nt, Homo sapiens
ucacuugaaccugggaggcagagguugcagugagccgagauugcacuguugcacuccagccuaggugacagaguga

SEQ ID NO: 55617 - RNA, 75 nt, Homo sapiens
ucacuugaaccuuggaggcagagauugcagugagccgagaucgugccauugcacucugcauuccagucuagguga

SEQ ID NO: 55618 - RNA, 69 nt, Homo sapiens
ucacuugaacucgagaggcagagguugcagugagccgacauagcaccacugcacucucagcuuggguga

SEQ ID NO: 55619 - RNA, 76 nt, Homo sapiens
ucacuugaagccaggaggcagaguuugcagugagcccagauggugccacugcacuccagccuuggcaacagaguga

SEQ ID NO: 55620 - RNA, 68 nt, Homo sapiens
ucacuugagcugaggaguuugagacugcagugagcuaugaucacaccacuguauuccagccugaguga

SEQ ID NO: 55621 - RNA, 92 nt, Homo sapiens
ucacuuguuaaaaugagcuaagugacuuguuaaagguugugugaccuuguuaaagaucacuuaacagucacuuagcucauuuuaauaaguga

SEQ ID NO: 55622 - RNA, 59 nt, Homo sapiens
ucagaacugauacuagaacuuuagauaguucuagugcuuguucuaguaucuaguucugg

SEQ ID NO: 55623 - RNA, 64 nt, Homo sapiens
ucagaagauuggcacuuauuagcacccugagcuaccuaaaagaauaagugcuugagacuucuga

SEQ ID NO: 55624 - RNA, 58 nt, Homo sapiens
ucauggcauuguuaaggguuuuaaaugagauaauacaaguucuuagcauaaugccuga

SEQ ID NO: 55625 - RNA, 74 nt, Homo sapiens
ucauguagugugauuuucacuagaaggucaauguaauaccaccuucaagucugcgugaaagaugcauugcauga

SEQ ID NO: 55626 - RNA, 58 nt, Homo sapiens
ucauguguugcacugaggaccugccaccuuaugugguguuuuugccaaaaaugcauga

SEQ ID NO: 55627 - RNA, 62 nt, Homo sapiens
ucaucucugauacugagaccuuggguuaggacuauucugaaaggguuucggauuagcaaugg

SEQ ID NO: 55628 - RNA, 69 nt, Homo sapiens
ucaucucuugccagucagaauggugauuauuaaaaaguccagaaacuauagaugcuggcgaggcugugg

SEQ ID NO: 55629 - RNA, 108 nt, Homo sapiens
ucaucugagaacuuguuagaaauacacauuccugggccucaccccgaucuacugaaucagaaacugguggggcccagcaaucugcgauuuaacaagucuucuggauga

SEQ ID NO: 55630 - RNA, 97 nt, Homo sapiens
ucauucaagagauuuauugaacaugccauauguaccagcuauugugcuaggugcuggugauauaacauguauaauaaagaaacaaauuuugugauga

SEQ ID NO: 55631 - RNA, 62 nt, Homo sapiens
ucauuccucuuaaagguaucauugaagcuaugggaaugagugagaucacuaagagguaaugg

SEQ ID NO: 55632 - RNA, 60 nt, Homo sapiens
ucauuuauugcucaugcauuuaauuucuuaucuaagaaaauggugccaugaccaauguga

SEQ ID NO: 55633 - RNA, 74 nt, Homo sapiens
uccaaaacuuagccgcuuaagacaacuucuacuauuucacuucugugguucaagaauuaaaguggcuuuuuggg

SEQ ID NO: 55634 - RNA, 82 nt, Homo sapiens
uccaaaauuaauuguccaaguucaucucucaaaaugaaauaauuucagcuagaaaugagcuguggcacaguaagccuuugga

SEQ ID NO: 55635 - RNA, 59 nt, Homo sapiens
uccaaggucuuuguuuggucuguaucagggcuacacaagccucauacaacaagcuugga

SEQ ID NO: 55636 - RNA, 66 nt, Homo sapiens
ucaucacuucuacucaacauuguacuggagguccuaaccagugcaauaaggauguagaacugauga

SEQ ID NO: 55637 - RNA, 66 nt, Homo sapiens
ucaucaguucuacauccuuauugcacugguuaggaccuccaguacaauguugaguagaagugauga

SEQ ID NO: 55638 - RNA, 98 nt, Homo sapiens
ucauaccuauaauaauuggcaauguuaauugaguauuuacuaugugccaaguucuguacuaagugcuugacuuugauguuuuauuuauuuauuuauga

SEQ ID NO: 55639 - RNA, 56 nt, Homo sapiens
ucauaggauaugaagguggaaauuuaaguaggaaaauuugccuauuauuccuaugg

SEQ ID NO: 55640 - RNA, 61 nt, Homo sapiens
ucauaggucugagaagaaaauaacuugaccaaauuuggcuuucuuuuuauuaggcuuguga

SEQ ID NO: 55641 - RNA, 62 nt, Homo sapiens
ucauagucuaagguucuuuugcauaugagaaaauacagucucuaagagaaucauagacuuga

SEQ ID NO: 55642 - RNA, 89 nt, Homo sapiens
ucauauaacucuguuuuuuucaugcauuuaauaauuguucuugcugcugugucuuuaucuucuuguaugaaaaggaauagauugaauga

SEQ ID NO: 55643 - RNA, 77 nt, Homo sapiens
ucaucaaaugucaaagguaggcaguaucacuugggaaguccaagucacagccuuuuacuuuagagaugaaaagaugg

SEQ ID NO: 55644 - RNA, 62 nt, Homo sapiens
ucaguuugccaguauuuuauggaggauuuucguauugauguucaucaguuauauuggccuga

SEQ ID NO: 55645 - RNA, 55 nt, Homo sapiens
ucaguuuuuaagaguuaugcgacuugaauagugauuugcaaauucuaaaaacuga

SEQ ID NO: 55646 - RNA, 80 nt, Homo sapiens
ucagguuuuauguucaguacuuaugggcauguuuuuauguuuccccaaaauaugucuggaguuacugagcugaagccuga

SEQ ID NO: 55647 - RNA, 62 nt, Homo sapiens
ucagucuacagcacugagcugugugcagggcuccuaugcacccugucagucuguagcacuga

SEQ ID NO: 55648 - RNA, 86 nt, Homo sapiens
ucagguaguucuuuauagcagugugaaaacagacuaauauagaaaauugguauugggaguggggcacugcuauaaagauaaccuga

SEQ ID NO: 55649 - RNA, 86 nt, Homo sapiens
ucagguauuuauuuauagcaaugcaagaauggcuuaauacagaaaauugguacugaggaguggggcauuacuauuaagauaccuga

SEQ ID NO: 55650 - RNA, 66 nt, Homo sapiens
ucgcacaucaaaugcuggcagagugccuggugcuuaguaggugcuuagugaguguuuguugaguga

SEQ ID NO: 55651 - RNA, 67 nt, Homo sapiens
uccguaaguaguauaagguuuuuugacagaaauuacuaucagaaauuaugccuacuacagugaugga

SEQ ID NO: 55652 - RNA, 77 nt, Homo sapiens
ucgcuugaacccaggaggcagagguugcagugagccaagaucgcgccauugcacucuagccucggcaacaagagcga

SEQ ID NO: 55653 - RNA, 77 nt, Homo sapiens
ucgcuugaacccgggagcuggagguugcagugagccaagauugugcuauugcacuccagccuuggcaacaagaguga

SEQ ID NO: 55654 - RNA, 83 nt, Homo sapiens
ucguauggucaugucauguuuaacuucuugaggaacuucuauguugucuuccauagcaguugaaccauuucauccauauacga

SEQ ID NO: 55655 - RNA, 60 nt, Homo sapiens
ucuaauauguauuuuaacguguaagggcuuggauacaacuacccuagaauacauaguaga

SEQ ID NO: 55656 - RNA, 91 nt, Homo sapiens
ucuaccuauugugguuuuuaaaguaccugugguccaggggcaguggcucacaccuguaaucccaggacuuugggaggccaaggugggcgga

SEQ ID NO: 55657 - RNA, 129 nt, Homo sapiens
ucuacuauuggcuccauacuaauguuccuugugauuuaaugcgucucugaguuuugcaugucuaagguuauuuacagcuuaaaagaugcauuuauauuaugauuagucaccggugagcuaugaaguaga

SEQ ID NO: 55658 - RNA, 58 nt, Homo sapiens
ucuacucuaccuucugccucuauggauuugccuauuugagguaccucauguaagugga

SEQ ID NO: 55659 - RNA, 61 nt, Homo sapiens
ucuagccauuaaucuugcauccaucucaaauccaguaugagaugcaagauuagauggggga

SEQ ID NO: 55660 - RNA, 83 nt, Homo sapiens
ucuauuugugaaaauucaucaaaugguuuguauauaugaaaaaaaugaaauauaccugcaggauguaauauuuugcaaguaga

SEQ ID NO: 55661 - RNA, 87 nt, Homo sapiens
ucucaaacaguaacacucuaaagggaugcacgaucuuuucuuuuauacaacagacagugcuuccaucuagagggucacugccugaga

SEQ ID NO: 55662 - RNA, 90 nt, Homo sapiens
ucucaaaccguaacccucugaaaggaagcacuuucuuuucuuucagacaacagaaagugcuucuuuccucgagaaggucacagccugaga

SEQ ID NO: 55663 - RNA, 87 nt, Homo sapiens
ucucaagcugugagucuacaaagggaagcccuuucuguugucuaaaagaaaagaaagugcuucucuuugguggguuacgguuugaga

SEQ ID NO: 55664 - RNA, 57 nt, Homo sapiens
ucucacagaguugaauguuucuuugauugagcaguuuugaaacacucuuuguguaga

SEQ ID NO: 55665 - RNA, 65 nt, Homo sapiens
ucucaugagauuaauaugacugccagggcccaguccuauguggaggaugggugucauucucgaga

SEQ ID NO: 55666 - RNA, 85 nt, Homo sapiens
ucucaugaugugaccaucuggagguaagaagcacuuuguguuuugugaaagaaagugcuuccuuucagaggguuacucuuugaga

SEQ ID NO: 55667 - RNA, 87 nt, Homo sapiens
ucucaugcugugacucucuggagggaagcacuuucuguugucugaaagaaaacaaagcgcuucucuuuagaguguuacgguuugaga

SEQ ID NO: 55668 - RNA, 100 nt, Homo sapiens
ucuaccccuucuagugauuauguggaaauaaaagaaagguuauucuguuuuaaaguaaaauuuuaucauuauauccaucagguucgcuagacaaauuaga

SEQ ID NO: 55669 - RNA, 116 nt, Homo sapiens
ucucccuauuuuguuccaaaauuggucauacaccuucugauauaugagaaguacacccagucccuggucuagagguagguguaugaacuaguucuggugaaugaacgugugggaga

SEQ ID NO: 55670 - RNA, 55 nt, Homo sapiens
ucuccuacacaucaguaagucaaagauaagcaacuuugacacuguuggugggagg

SEQ ID NO: 55671 - RNA, 76 nt, Homo sapiens
ucuccugcauuugugaaugucauaagcuccacccugaguuuuagcccuuggauucucuggcguucaucaauggaga

SEQ ID NO: 55672 - RNA, 87 nt, Homo sapiens
ucuccugcugugacccucaagauggaagcaguuucuguugucugaaaggaaagaaagugcuuccuuuuugaggguuacuguuugaga

SEQ ID NO: 55673 - RNA, 65 nt, Homo sapiens
ucucugaggaagaggcuguaauuugcaugcuuaaucucaugucuauuccacuuuuccuucaggga

SEQ ID NO: 55674 - RNA, 63 nt, Homo sapiens
ucucugugguuuuccagaaauuuauuacugacauuauaaggcuuucugggggagcauggcagg

SEQ ID NO: 55675 - RNA, 70 nt, Homo sapiens
ucucuuuaguugucuccucaaggguacuagucacucaguagaguaccauuugguugggcagccaaagaga

SEQ ID NO: 55676 - RNA, 66 nt, Homo sapiens
ucucuuucccaguucacagaaaugcucugagcaccaugcuaccauugcaguggaguggggaagagg

SEQ ID NO: 55677 - RNA, 59 nt, Homo sapiens
ucugaaacucaugauucuagccaagucugaaggcaaccaaaagagcacugaguuuuaga

SEQ ID NO: 55678 - RNA, 59 nt, Homo sapiens
ucugaaagagcauuugaaugggugcggcaguccacaccuguaauaucagcacuuugaga

SEQ ID NO: 55679 - RNA, 63 nt, Homo sapiens
ucugauccaaucugugggcugucaguuuacaauuucugcuguauagcacuucacuugguuaga

SEQ ID NO: 55680 - RNA, 73 nt, Homo sapiens
ucugaugagaauguguuaaaauggagacucucaucauugcuugugagaguauaaauugaugcagccucucaga

SEQ ID NO: 55681 - RNA, 56 nt, Homo sapiens
ucugauuaagguaaccuggccuugguccaccacuuuacuaaguccccuugauuaga

SEQ ID NO: 55682 - RNA, 66 nt, Homo sapiens
ugaauucuguuagaagguaguucagcacacccucauuuauggacugaaaugccuuuaaugaauuua

SEQ ID NO: 55683 - RNA, 72 nt, Homo sapiens
ugaauuuggaauguaacuugaaacuuuuaucacacauuuugucaaaaguuuauacuacauuuuggggauuca

SEQ ID NO: 55684 - RNA, 64 nt, Homo sapiens
ugacccaguuauucaacuuccucaguuaacagcaaagaggcaugagaggugaauggcaggcuca

SEQ ID NO: 55685 - RNA, 85 nt, Homo sapiens
ugacuacuuaagugaauuucacuacugagugacaaagaggaaaaaaggccauuuauagaauaugaaguuuagacuuaguagcuca

SEQ ID NO: 55686 - RNA, 55 nt, Homo sapiens
ugacuagagcaauuggaaacaauuguuaaaaauuguuuuuaaaauguccugguua

SEQ ID NO: 55687 - RNA, 85 nt, Homo sapiens
ugacuccggaguauaaaugagagaauuucugauagguuuguaaugcauaauuacauugucauauucucucucuuuuugguaguca

SEQ ID NO: 55688 - RNA, 76 nt, Homo sapiens
ugagaaacuuuuacuagaaccuuauucagagugauuucucuuucucugagauugguucuguguuaguccauuuuca

SEQ ID NO: 55689 - RNA, 65 nt, Homo sapiens
ugauauugaggaaugugauuucaaauacuucacagugauguauuaauuauuucacucgacuguca

SEQ ID NO: 55690 - RNA, 80 nt, Homo sapiens
ugaucaaacccuugcugaggauuuggccauugacaugggcuucugguuaaucaggccguuuccuaagaagagucagguca

SEQ ID NO: 55691 - RNA, 58 nt, Homo sapiens
ugagcggcuuucaaaucuggcaucagguaauaacuuguuugccaagaaagucagcuua

SEQ ID NO: 55692 - RNA, 58 nt, Homo sapiens
ugagcugagaucgcgccauugcauucuagccugggugacagugugauacuuagucuca

SEQ ID NO: 55693 - RNA, 58 nt, Homo sapiens
ugaugcuuggcuuccaaucccagacacugauuuuguaugagaugugaccagggcauca

SEQ ID NO: 55694 - RNA, 58 nt, Homo sapiens
ugauggaagaagccaaguuuccugaguggccacuaggaaaacucugucuucuuuauca

SEQ ID NO: 55695 - RNA, 68 nt, Homo sapiens
ugauaucuuuuguauggugagcugcacauuuaauaaagaagcagcugccacuacugaacgauuaauca

SEQ ID NO: 55696 - RNA, 58 nt, Homo sapiens
ugaugagauaaaccaucucuuaagugcagaaauauuugaugaugguuuccuuuccuca

SEQ ID NO: 55697 - RNA, 107 nt, Homo sapiens
ugaugauuaaaaaaaaguguuggcuucauaguuuugcuguaaaacuuacuuugggcaauacagauaaagugcuuacagggaacaugaugcguugcaaacacucauca

SEQ ID NO: 55698 - RNA, 78 nt, Homo sapiens
ugauccuacugugugaaucaauugaucuaugugucugaucuuucacagaaccauacugucuugauuauuguaguauua

SEQ ID NO: 55699 - RNA, 98 nt, Homo sapiens
ugauccucuguccauaguaaguuacgcauguagugacaaaugcaugccacaaggucuugagauuguaucugcaauguguugcugcuggcuguugauca

SEQ ID NO: 55700 - RNA, 61 nt, Homo sapiens
ugaucucagcucacugguugaaacgauucuucugccucagccucccaaguagcugggauua

SEQ ID NO: 55701 - RNA, 55 nt, Homo sapiens
ugaucucagcucagugcaaccucugccucccggguucaagugauagcugggauua

SEQ ID NO: 55702 - RNA, 59 nt, Homo sapiens
ugaucucaggugauucacccacuuuggccucccaaagugcugggaucacacugaaauca

SEQ ID NO: 55703 - RNA, 94 nt, Homo sapiens
ugagaaucgcuugaauuuggcaggcaaaguuuacagugagccgagauggcaccauugcacuccagccugcacgacacagcgagacaccaucuca

SEQ ID NO: 55704 - RNA, 62 nt, Homo sapiens
ugagaaugaugauuuccaauuucauccaugucccuacaaaggacaugaagucaucacuuuua

SEQ ID NO: 55705 - RNA, 102 nt, Homo sapiens
ugagacagaguuuuguucuuauugcccaggcuggagugcaauggcgccaucucggcucauugcaaucucugccucccggguucaagcaauucuccugucuca

SEQ ID NO: 55706 - RNA, 64 nt, Homo sapiens
ugagacauauuauacugcuuuuaucuuuacuuuugaaaggcaaugcagucauggaaugcucuca

SEQ ID NO: 55707 - RNA, 57 nt, Homo sapiens
ugagacgaagucuugcucuguugccaagcuggagugcaguggcacgauuucggcuca

SEQ ID NO: 55708 - RNA, 58 nt, Homo sapiens
ugagacggagucucgcucugucacccagacuggagugcaguggcgcgaucuccgcuca

SEQ ID NO: 55709 - RNA, 58 nt, Homo sapiens
ugagacggagucucgcucugucgcccaggccggagugcaguggcgcgaucuccgcuca

SEQ ID NO: 55710 - RNA, 58 nt, Homo sapiens
ugagacggagucuugcucugucacccaggcuggagugugguggcaagaucuccgcuca

SEQ ID NO: 55711 - RNA, 58 nt, Homo sapiens
ugagacugagucucacucugucacccaggcuggagugcaguggugcgaucucagcuca

SEQ ID NO: 55712 - RNA, 57 nt, Homo sapiens
ugagacugagucuugcucugucacccagguggagugcaauggcaugaucucagcuca

SEQ ID NO: 55713 - RNA, 59 nt, Homo sapiens
ugagacugagucuugcucugucgcccaaagcugaagugcaauggcaagaucucggcuca

SEQ ID NO: 55714 - RNA, 59 nt, Homo sapiens
ugagacugaguuuugcucuuguugcccaggcuggagugcaacgucacaaucucagcuca

SEQ ID NO: 55715 - RNA, 58 nt, Homo sapiens
ugagauaggaucuugcucuguuguccaugcuggaguacaguggugugaucauaucuca

SEQ ID NO: 55716 - RNA, 64 nt, Homo sapiens
ugagaucaaggugggcccugggggccgcccccgccaugcccugcagugcucaccuugggucuca

SEQ ID NO: 55717 - RNA, 64 nt, Homo sapiens
ugagaugaacuugauuguuuuaggacuaaauguuuuuauucaauugacaauuagagaucacuca

SEQ ID NO: 55718 - RNA, 74 nt, Homo sapiens
ugagaugaagugauguaaaacauggggcuacuguuuucucuccaucuccccucgccuugccucgccucaccuca

SEQ ID NO: 55719 - RNA, 57 nt, Homo sapiens
ugagaugaguugcgcucugucgcccaggcuggagugcaguggcgcgaucucggcuca

SEQ ID NO: 55720 - RNA, 101 nt, Homo sapiens
ugagauggagucucacucuguugccgaggcuggagugcaguggcgugaucuccacucauugcaacuucugccucccagguucaagugauucuccugccuca

SEQ ID NO: 55721 - RNA, 102 nt, Homo sapiens
ugagauggagucucgcucuugucacccaggcuggagugcuguggcgcgauuccggcucauugcaaucucugccucccggguucaagugauucuccugccuca

SEQ ID NO: 55722 - RNA, 55 nt, Homo sapiens
ugagauggagucuugucgccuaggcuggaguguggagcacaguggcgccaucucg

SEQ ID NO: 55723 - RNA, 101 nt, Homo sapiens
ugagauggaguuuuacuuuguugccuaggcuggagugcaguggcgcgaucucggcucacugcaaccucuaccucccagguucaagugauucuccugucuca

SEQ ID NO: 55724 - RNA, 55 nt, Homo sapiens
ugagauggguaauuaaauggugaauguauucacauguuuucaauugcugaucuca

SEQ ID NO: 55725 - RNA, 65 nt, Homo sapiens
ugagauuauauuucuuaacagaaauuuacuuaacugugaggaugcuguguggcaaguauuucuca

SEQ ID NO: 55726 - RNA, 58 nt, Homo sapiens
ugagauucuggguggauauaaauuuggggggaacucuauuaaaucuagugcagacuca

SEQ ID NO: 55727 - RNA, 65 nt, Homo sapiens
ugagauuugggaggggccaggggcagaauuauaugguuaggcuuuguguccccacccaaaucuca

SEQ ID NO: 55728 - RNA, 64 nt, Homo sapiens
ugagcacauuuacaucaguucccugugucccccaagucugaugauggugauauggaugugcuca

SEQ ID NO: 55729 - RNA, 72 nt, Homo sapiens
ugagcaggcaauggauauaaaagagauaagaacagaugaaccaaucucaguguuaucuaucugccuucuaca

SEQ ID NO: 55730 - RNA, 76 nt, Homo sapiens
ugagcauaagugcuucagaagacaauauuuuccaaaaaaguuucaaggugaauauuucuaauguggcaucuguuca

SEQ ID NO: 55731 - RNA, 62 nt, Homo sapiens
ugaggaacuagcuacccuaauaggaaggacuugucuugcaacuaggucuggcuggcuuuuca

SEQ ID NO: 55732 - RNA, 65 nt, Homo sapiens
ugaggaggcagucugucccuuagcagagcucaggcacugugcuaggagauccacugcucucuuca

SEQ ID NO: 55733 - RNA, 87 nt, Homo sapiens
ugaggauauuaauuuuguauugcuugaggaaaugguaauguccuccccugaggcaguugcccugcaagacaguacugaugcucuuca

SEQ ID NO: 55734 - RNA, 65 nt, Homo sapiens
ugaggaugcagucugucucuuagcagagcuacagcgcugugcuaggagaucugcugcucucuuca

SEQ ID NO: 55735 - RNA, 102 nt, Homo sapiens
ugaggcaagagaauugcuugaacccgggagguggaggcugcagugagccaagaucacgcuguugcacuccagccugggcaacaagagcaaaacuccgucuca

SEQ ID NO: 55736 - RNA, 101 nt, Homo sapiens
ugaggcacgagaaucgcuugaaccugggacguggagguugcagugagcugagaucaugccauugcacuccagucugggcaacagagugagacucagucuca

SEQ ID NO: 55737 - RNA, 102 nt, Homo sapiens
ugaggcaggagaaucacuugaaccugugaggcagagguuguagugagccaagauugugccauugcacuccagccuaggcaacaagagugaaauucugucuca

SEQ ID NO: 55738 - RNA, 94 nt, Homo sapiens
ugaggcaggagaaucacuugaauccagaagguggagguugcagugagccaagccauugcacaccagucugggcaaagagugaaacucugucuca

SEQ ID NO: 55739 - RNA, 101 nt, Homo sapiens
ugaggcaggagaauugcuugaaacugggaggcagagguugcagugagccaggaucuagccauugcacuccagccuggccaacagagcgagacucugucuca

SEQ ID NO: 55740 - RNA, 105 nt, Homo sapiens
ugaggcaggagaauugcuugaacccgggaggcugagguugcaguugcagugagccaagacugugccacugcacuucagccugggugacagagcaagacugucuca

SEQ ID NO: 55741 - RNA, 130 nt, Homo sapiens
ugaggguugucaaggacacucaggcaggauuugacccaaaagagaugaagguccugacuguacuccaguauggcugcagcauaaucagauuuuccucucucucugucacugucucagaaagcagccuuca

SEQ ID NO: 55742 - RNA, 92 nt, Homo sapiens
ugaggucuuuuuuucauggaauauagucauuuuuauaacauggcagucuuucccugcauuuaaaaugauuuuguucuggaaaugagagcuua

SEQ ID NO: 55743 - RNA, 59 nt, Homo sapiens
ugagucagaauuuugcucuuguugcccaggcuggagugcaauggcacaaucucugcuca

SEQ ID NO: 55744 - RNA, 91 nt, Homo sapiens
ugagucuucucauucuagacacuagauaugugacugauugagugaggaagacaaucacucacaugccuagugucuaggauaagaagauuca

SEQ ID NO: 55745 - RNA, 65 nt, Homo sapiens
ugaguguauguagugaccagggccagagguacuggacuucugaaacuuggacuuuauacgauuua

SEQ ID NO: 55746 - RNA, 84 nt, Homo sapiens
ugaguguauguguguguguacacuuagggguguguaugugaauccaugucugagugucccagugugcauacaggugugugcuca

SEQ ID NO: 55747 - RNA, 64 nt, Homo sapiens
ugaguguuuuuaucaugaaaggguauuagauuuuaucgcauccuucuguuuauggagaugcuca

SEQ ID NO: 55748 - RNA, 56 nt, Homo sapiens
ugaguuagguugucaaugucuuaaggaaugugauccuugaauuccaaccugauuca

SEQ ID NO: 55749 - RNA, 129 nt, Homo sapiens
ugaguugaaauaaucaauaguguuaagaugucuauuuucugcaggaaggaaauagacaguauuaauaacgaagucaauuuccuguaggaaggaaauagacaucuuaacacuauugauucuuucaauuaa

SEQ ID NO: 55750 - RNA, 72 nt, Homo sapiens
ugaguuggaauguauugcuacuucuucgaaucuuggaagaguuuguguagaauugguauuauuucuuccuua

SEQ ID NO: 55751 - RNA, 84 nt, Homo sapiens
ugaguuuggaaaauuaucaucugaagauugcuguucaacuuuuggagagugauauucagaugcuuugaagacuuccaauauuca

SEQ ID NO: 55752 - RNA, 58 nt, Homo sapiens
ugauagugcuuauccaggagaacugacaggacaguuuugagugugauaaacacuguca

SEQ ID NO: 55753 - RNA, 77 nt, Homo sapiens
ucuucagcagugguuuuaaguagagcauacuaaagcaauaguagugugcaggauuuugaugccaucuccgcugaagg

SEQ ID NO: 55754 - RNA, 55 nt, Homo sapiens
ucuucaugucuucaaugggggggguaacauauaccuucugagguugcuaugaagg

SEQ ID NO: 55755 - RNA, 106 nt, Homo sapiens
ucuuccucaugggguccccuuuuuucuuagcaacauucagcucagguacagaugagaauuauguucaucuagggugaguguggccagaaggcagggcaggggaggg

SEQ ID NO: 55756 - RNA, 129 nt, Homo sapiens
ucuuccucuuucucuuccucccccuccucuucuuccuucuucuuagugguauagacuugaaauuguuuaaagcaugacgagaagaagcuuuuggagagagaggcugaagaaucggggagcagaggaagg

SEQ ID NO: 55757 - RNA, 59 nt, Homo sapiens
ucuucuacagugacugcagccauagcauugaugcugguggaugcugugcugugugagga

SEQ ID NO: 55758 - RNA, 113 nt, Homo sapiens
ucuggguauccagcucuuuacugaucuacauggcacagaguagaugcucaauaauauuuuguuacauauuuguucuguccagagaaggggauuagcaaagugggcacagcaga

SEQ ID NO: 55759 - RNA, 76 nt, Homo sapiens
ucuguaaccuagcagacacuuccagagaguucuccagcaaauuuucugccagugugaugcuaacaguggaagcaga

SEQ ID NO: 55760 - RNA, 62 nt, Homo sapiens
ucugugaaucugggaacacaauuaagcuacuaauauuuguuaauuguccuugauuacacaga

SEQ ID NO: 55761 - RNA, 64 nt, Homo sapiens
ucuguguaaaacaauuagaggauuuuuuaaaaucuuaaaagucuucacuguguauuacaauaga

SEQ ID NO: 55762 - RNA, 74 nt, Homo sapiens
ucuguuuaaacgaaauugcucagaagcccuauauguaaaauagguauaaauggagcagcuuugguugaagcaga

SEQ ID NO: 55763 - RNA, 78 nt, Homo sapiens
ucuguuugaaucacaguuauuagagcagccacaggcagggccacgagcggaggcugcucaacugugaugacagccgga

SEQ ID NO: 55764 - RNA, 120 nt, Homo sapiens
ucuguuuucaaucuuucaaaagacaugugaaaaaugaaguuggccugagguuugaggcagauguuuugacugauuugugcucaucucagucaacuguuuucucaagggguugggagcaga

SEQ ID NO: 55765 - RNA, 80 nt, Homo sapiens
ucuuaaucucuguuucuguuauaauaggaagacugcagcuuuguuuacuuucugaggagaauagagaacagggagaaaga

SEQ ID NO: 55766 - RNA, 100 nt, Homo sapiens
ucuggcucaaguuucuaauauccuuuuaaauguaaaugagaaauauauauacauuauuccauugaacaugaaggaaugugugccauggauuuggcccaga

SEQ ID NO: 55767 - RNA, 55 nt, Homo sapiens
ucuccagguagauaugucaggaaucauuugaaauacuuauaugucugcuggggga

SEQ ID NO: 55768 - RNA, 92 nt, Homo sapiens
ucugcuacacaugcaggcucccugcccucugaagcacuuuuuagauacaaaggcaggugaccaccuguauguaccccaaagacuguggcaga

SEQ ID NO: 55769 - RNA, 70 nt, Homo sapiens
ucuggacaaccaagaacagagggaaagaggcagagcacucuuuggagaaaaguucuugggcuuguccaga

SEQ ID NO: 55770 - RNA, 86 nt, Homo sapiens
ucuggccauuuaaagccauugucaaguuuguacuggggccaagcgguguugcagaagaagauaaggcauuuagguuuuaggucggg

SEQ ID NO: 55771 - RNA, 60 nt, Homo sapiens
ucugccacugacaccucaaggaccauuggaucuccugggucauagggcucaaguggcaga

SEQ ID NO: 55772 - RNA, 86 nt, Homo sapiens
ucugccucucaaagugcugggauuuuaggcaugagccacugaacccggccaagucucaaaaacucagauaguuuacccaaaguaga

SEQ ID NO: 55773 - RNA, 67 nt, Homo sapiens
ucugccuuagcagcaauuaucaaucucauuaaccuauagacauguuuguuggauaguuguuggcaga

SEQ ID NO: 55774 - RNA, 66 nt, Homo sapiens
ucucgagaguuccagugacuguugcaaaugccuuuaacucuucagcucacugugaacuucuugagg

SEQ ID NO: 55775 - RNA, 70 nt, Homo sapiens
ugaaccauaugaaauugccguuuuugugggucagaaugauggccuaauauuggugguuuuaugugguuua

SEQ ID NO: 55776 - RNA, 88 nt, Homo sapiens
ugaaaagcuucugaauaaagguguuguucaacacaauucuagaaugcuggaccuuuuaugaacagcacguuuauucagaagccucuca

SEQ ID NO: 55777 - RNA, 55 nt, Homo sapiens
ugaaacacacauugcccuuuaucugagaguucugaaagggcagaggugugucuca

SEQ ID NO: 55778 - RNA, 59 nt, Homo sapiens
ugaaacacaccuccucuccauccuuagugaccccuucauggugaugucgguguguuuua

SEQ ID NO: 55779 - RNA, 63 nt, Homo sapiens
ugaaacauacacucugauggggaagcgaagcgcagagaugcucaucuaguguaugugaauuca

SEQ ID NO: 55780 - RNA, 60 nt, Homo sapiens
ugaaauuauucuuaccaaggugauauccaggaucucugcccuuguucaggaauaguuuca

SEQ ID NO: 55781 - RNA, 89 nt, Homo sapiens
ugaacugaggucacugguagaugcuuaagguguacauaugugugugugacucaguacaguuuucaguguucacugaacacuucaguuua

SEQ ID NO: 55782 - RNA, 79 nt, Homo sapiens
ugaacuguaucuuaaaggcuucggaucagaagguaaaacauuuuacuuuaauauaugugaaguucugagacucaacuca

SEQ ID NO: 55783 - RNA, 90 nt, Homo sapiens
ugaagaacuaggugccuggaauguuccuaaagauucacuugggaaacagcuuaauauaguggacuuuggcaacagaccaacuaggcuuca

SEQ ID NO: 55784 - RNA, 61 nt, Homo sapiens
ugaagacauuuuuggguguguagucuuccccaucucacucaacacucuucauaugucuuca

SEQ ID NO: 55785 - RNA, 72 nt, Homo sapiens
ugaagggcaaacacugugugauuauuucaauugaugcugagaaagcauuugaaauaauucaacaucccuuca

SEQ ID NO: 55786 - RNA, 86 nt, Homo sapiens
ugaauauuauuuggcuguauggauguacuauguuuccuuuauucuuuugcaaguaaauauccgguagucccagcaccauuuauuca

SEQ ID NO: 55787 - RNA, 77 nt, Homo sapiens
ugaaucauacaguaguccucacuugugcaaacccuccucauucaguucauacaagcuaaguugcugcuugugauuua

SEQ ID NO: 55788 - RNA, 130 nt, Homo sapiens
ugaaugaauaagauacuaggaaaaugaugaaguacugugauacuguacugaaguacccauuuaguacagcgauacuaaaguacuaaaguaaguauagugauacagaugaaaucagauaucauuucagaaa

SEQ ID NO: 55789 - RNA, 56 nt, Homo sapiens
ugaaugcuucaugucugggcuguaagaucuacugugagcccuacaugaugcauuca

SEQ ID NO: 55790 - RNA, 56 nt, Homo sapiens
ugaauguaagaugucugcuggucaucaguuacauaaucagcaaauauaaacauuca

SEQ ID NO: 55791 - RNA, 78 nt, Homo sapiens
ucuuucaucuuugcugauugucaucaauauuauuaccaaucuugguaguacuuuaggugagaguaaugagauugaaga

SEQ ID NO: 55792 - RNA, 74 nt, Homo sapiens
ucuuuccccacagugguuuucaacuccaccugcauguuggaaucaucuagggagcuugaaaccaaggggaaggg

SEQ ID NO: 55793 - RNA, 69 nt, Homo sapiens
ucuuucuagcagugcaagaacagacuacuacagaaaauugguaccaggagugguguauugcuaaaaaga

SEQ ID NO: 55794 - RNA, 83 nt, Homo sapiens
ucuuucuaguugucuuuuaaagcuaaaauauguuuauuguaaauugaaaucaugagcagaugaguuuuaguagagcuaaaaga

SEQ ID NO: 55795 - RNA, 62 nt, Homo sapiens
ucuuugcuucugacuuuaaugucuuucaaauuuaugagauacacccagugcagaggcuaaga

SEQ ID NO: 55796 - RNA, 55 nt, Homo sapiens
ucuuuggucuacuuucauauguuauguuuucugaacaugagaguagaaauaagga

SEQ ID NO: 55797 - RNA, 59 nt, Homo sapiens
ucuuugucuuuaaacaucuuguucaguaaaccugcugaauacugugcaaaggauuugga

SEQ ID NO: 55798 - RNA, 90 nt, Homo sapiens
ucuuuuaucugaugagaugacuagaggagggauggccaaauaagguuuaucuggggucccaacucugauugauuggaauuggcugaagga

SEQ ID NO: 55799 - RNA, 60 nt, Homo sapiens
ucuuuucaaguauucaagugauagagaaugugucugucugugaaugaacacuugaaaaga

SEQ ID NO: 55800 - RNA, 68 nt, Homo sapiens
ucuuuucuggaaguagauagauugugucaguggucaacaccucugccaaagucaacuucuaaaauaga

SEQ ID NO: 55801 - RNA, 74 nt, Homo sapiens
ucuuuuggcuuacaguucugguggagagguaagugaaguuuaccaaagcagugaauugucauuaagcuagagga

SEQ ID NO: 55802 - RNA, 75 nt, Homo sapiens
ucuuuuuggagucugauuuuuauguugcucauuuacuuaggaaucgagaauuucuaguucagaacugcaaaaaga

SEQ ID NO: 55803 - RNA, 81 nt, Homo sapiens
ucuugggaaguuugcaguagcucuaaggguucaacaagcaaaauaaaacccugugaauauuuaaacuucagucauccagga

SEQ ID NO: 55804 - RNA, 130 nt, Homo sapiens
ucuugggcaagucucugaagguaucuggccagagcguccuccuuuacaguuggacucacgagggcccuuggcaacuccauaguccucugaguccauguagaagugcuuuggaaagagacagggcugaaga

SEQ ID NO: 55805 - RNA, 74 nt, Homo sapiens
ucuugguaacaauuucugucucagguuguuugugcugcuauaacagaauaccugagacuaggcauuuuauaaga

SEQ ID NO: 55806 - RNA, 67 nt, Homo sapiens
ucuugguuauggaaggcugugguuggccuuguaacaaccugcaauaauugcaccaucuagaucaaga

SEQ ID NO: 55807 - RNA, 70 nt, Homo sapiens
ucuuuaagcagugcaagaauggaauaauaccauaaauugguggcuguagaguggguuacugcuauaaaga

SEQ ID NO: 55808 - RNA, 69 nt, Homo sapiens
ucuuuacagcagugccccacucccauaccaauuuacuguacuggucuguucucacacugcuguuaaaga

SEQ ID NO: 55809 - RNA, 70 nt, Homo sapiens
ucuuuauagcaguguaagaaucgaguaacacagaaaauugguacugaggagugagccauugcuauaaaga

SEQ ID NO: 55810 - RNA, 71 nt, Homo sapiens
ucuuuauagcagugugaaaauguacuaauacagagaauugguauugggauagugggguauugcuguaaaga

SEQ ID NO: 55811 - RNA, 71 nt, Homo sapiens
ucuuuauagcagugugaaaauugacugauauaggaauucuguaccagacgaguggagcacugcuauaaaga

SEQ ID NO: 55812 - RNA, 69 nt, Homo sapiens
ucuuuauagcagugugagaaugaacuaauacagaaaacugguacugggagugaggcacugcuauaaaga

SEQ ID NO: 55813 - RNA, 58 nt, Homo sapiens
ugcaaugggaaaaucagaaggccugggggccccagaccuagauuuuacucagcuugca

SEQ ID NO: 55814 - RNA, 78 nt, Homo sapiens
ugcaccuuuucaauuggcagugcucuugccacaugaaucgcucaucugcccaggauguuuugccaaacauaggugaca

SEQ ID NO: 55815 - RNA, 87 nt, Homo sapiens
ugcacggguguguguacugcaugggugcaugcugcuugggugugugugggcagcauugccuuugcagugagugcagaccucugugua

SEQ ID NO: 55816 - RNA, 99 nt, Homo sapiens
ugcacucauccauccacuuagucacacacucaacuuuucaucuugggugauggagguugggaugcuugugauuuuggugaggauagagauugagaugca

SEQ ID NO: 55817 - RNA, 56 nt, Homo sapiens
ugaugguuuuaaaaagaggaguucccuuguacaacucucucuuuuuccugcucuca

SEQ ID NO: 55818 - RNA, 103 nt, Homo sapiens
ugauguguuuaacucauuuaaugccccuaucaacccuaugagguagguacaauuacuaucuccauuguccagaugaggaaauuggguaaguuaaacaacauua

SEQ ID NO: 55819 - RNA, 81 nt, Homo sapiens
ugauuaugugcgugugugguuuuuuucuccaauaggcaauuauuuccagucagagaaggaaaccagugccuggcauucuca

SEQ ID NO: 55820 - RNA, 63 nt, Homo sapiens
ugauuuaaaguguaugggaggaugugcauagguuauaugcaaaugcuaugccauuuuauauca

SEQ ID NO: 55821 - RNA, 74 nt, Homo sapiens
ugauuugaucuguuuuccuauuguuuguugaugcuuuuauugacagaauuaaugaaaauuacaagguuaaguca

SEQ ID NO: 55822 - RNA, 84 nt, Homo sapiens
ugccaguuugagaagcacagggccugugcuuucaguuuucucacauuugaauauuauguuguauggguuuuguuucuucuggua

SEQ ID NO: 55823 - RNA, 101 nt, Homo sapiens
ugcauguuuuuaaguaaguuggaugucagagguaacaauuuggauugguuaauuucuucaacagugauggccuuuguauuuaauagcuaugacaauaugca

SEQ ID NO: 55824 - RNA, 74 nt, Homo sapiens
ugcagucacagugacaggaugugguucucaucuuggccaagaacaacagcuccauauucugccauugcauugca

SEQ ID NO: 55825 - RNA, 68 nt, Homo sapiens
ugcaguuuaggaacugguaacauugauuucuacucuauuuaccagcguuucuaauuggaaaagcugca

SEQ ID NO: 55826 - RNA, 84 nt, Homo sapiens
ugcauccucaucuucuuuuaguggaauauuuacaguuucuucagcuggacuaucaaaucuuucacuagucaguuguuggaugca

SEQ ID NO: 55827 - RNA, 100 nt, Homo sapiens
ugcagccaagagccuggggagagcuggcugcuguccagcccaccggcuggguccugcaguggacagugaaugccacuccucccucccccuaaucacugug

SEQ ID NO: 55828 - RNA, 68 nt, Homo sapiens
ugcaggcaugacauuucacucuuagauaugccaggauauaccuucuaagaaugugaacauucucugca

SEQ ID NO: 55829 - RNA, 82 nt, Homo sapiens
ugcagaugcccccuggacuguacuccuggccaguguggaccccaaagcuaccucagugacagucaagggccugguuccugca

SEQ ID NO: 55830 - RNA, 76 nt, Homo sapiens
ugcaauuccugaguguagaaacuucuugcacuuauuuaaaauuuaggagagaacauuuaagccacucagguaugca

SEQ ID NO: 55831 - RNA, 70 nt, Homo sapiens
ugcacuuacuuuuaaggggccuugauuuaggagucugguauuaccuaaaugcucuuuaaaagugcuugca

SEQ ID NO: 55832 - RNA, 86 nt, Homo sapiens
ugccacuggguuguguccccaugcaguuggucagagucccuucagagugguggccuuggcaauggcuggggcugaaacaaguggca

SEQ ID NO: 55833 - RNA, 82 nt, Homo sapiens
ugccaucagagacccaguagccagauguagcugcugauuacgaaagacaggaucuacacuggcuacugagccauugagggua

SEQ ID NO: 55834 - RNA, 55 nt, Homo sapiens
ugccaucauaaaaauaugugcuuauuauauguuagguacauaguauuuaguggca

SEQ ID NO: 55835 - RNA, 59 nt, Homo sapiens
ugccuaagcagaaguuugcugcaggggcagggcccucauggagaacaucugcuagggca

SEQ ID NO: 55836 - RNA, 67 nt, Homo sapiens
ugccuccaggaaugacacugauucugcaccuuuggcagugugcacaaucgugcauuccuugucugca

SEQ ID NO: 55837 - RNA, 76 nt, Homo sapiens
ugccuccauagcaggaagaaagcuacucaggagacagcucuuaucacugagacacucuuaucugcauaacaaggca

SEQ ID NO: 55838 - RNA, 62 nt, Homo sapiens
ugccugaaaguuauucaggggcaaguuguuuaauuuccuugcaacuuugugauuuuaaggua

SEQ ID NO: 55839 - RNA, 74 nt, Homo sapiens
ugccugaaucauugcauuaucaagggcaucucuuucuaucaagccauuugcucaaagcagugaaaucuucagca

SEQ ID NO: 55840 - RNA, 64 nt, Homo sapiens
ugccuuuuggucacugccgccgccagcagcccaggcugacugguuugacaguggccauugugca

SEQ ID NO: 55841 - RNA, 66 nt, Homo sapiens
ugcugagauguuuuguuaucaaaggauuguuaauauguggugccugauaauagacauucauaagua

SEQ ID NO: 55842 - RNA, 60 nt, Homo sapiens
ugcugggauuacaggcaugagccacugugccuggcugcauugucccucuuaaucccagca

SEQ ID NO: 55843 - RNA, 58 nt, Homo sapiens
ugcuucaguaguaaauuguuauugaagcuucagucaauagcaaauugcuauuaaggca

SEQ ID NO: 55844 - RNA, 98 nt, Homo sapiens
ugcuuccuuagaacagucuccccauccuuuagacuguccaguugaguuucuagaauuccagcucagggcugaaggcuggggugguuauugagauggca

SEQ ID NO: 55845 - RNA, 70 nt, Homo sapiens
ugcuucuuguucagagaauaaaaauuggugucugaaugcccaguuuugcuucucaugagggacugaagua

SEQ ID NO: 55846 - RNA, 85 nt, Homo sapiens
ugcuuguagagauauaauuuuguuuugugguguaauucaggcugcauuccaguagauggcacuuaagagcaagagccuacaggua

SEQ ID NO: 55847 - RNA, 85 nt, Homo sapiens
ugcuuguggagugagagaugaugugguagaaaagaagcugcauucauucauucauuuauucauucauuugcucacuccacaagua

SEQ ID NO: 55848 - RNA, 59 nt, Homo sapiens
ugcuuuucauagaucaugcuuuuggaaaagucuuccuaaagccagcauccuggacagca

SEQ ID NO: 55849 - RNA, 129 nt, Homo sapiens
ugcuuuuguuuuuuuuugagacagaguuuuugcucuuguuguggaggggagugcaguggggcgaucucagcucacugcaaccucugccucccagccugaagugauucuccugccucagccucccaagua

SEQ ID NO: 55850 - RNA, 68 nt, Homo sapiens
uggaaaguacugagguccaccugaaguguuugaucacuaacuuuggguaagccagucauacuguuuca

SEQ ID NO: 55851 - RNA, 74 nt, Homo sapiens
uggaaaguaguucuaaucuaaggacuuuauuuccccuacauuugucccuuuggaaauuuggaauaacuuugcca

SEQ ID NO: 55852 - RNA, 129 nt, Homo sapiens
uggaaaugagcagagcacauuaauaucgaagaaucugugauuuuccaguggcccugaucaugauucuuuuguggucugguuagggguuggauaacagagaaccuuggguuuauucuacugcuaccucca

SEQ ID NO: 55853 - RNA, 90 nt, Homo sapiens
ugcuaugaaacagcaucaagugcuacagagaaaucuuucacgaaagaaagaggcaaucaauguagcaaacuucauuguugucuuauugua

SEQ ID NO: 55854 - RNA, 78 nt, Homo sapiens
ugcuauugugaaugaugucgcaguaaacauacaugugcaugugucuuuauagcagcaugauuuauaguccuuugggua

SEQ ID NO: 55855 - RNA, 55 nt, Homo sapiens
ugcucaguuuaaaacuuuugaguauugaagugaugcucaaacaaaaugcugagua

SEQ ID NO: 55856 - RNA, 90 nt, Homo sapiens
ugcuccacaccuggcucacccuuggcagcuguggaaucugggcugguaacgcaagcugagcacagccugccaagcugagugaguggagua

SEQ ID NO: 55857 - RNA, 67 nt, Homo sapiens
uggauuaagugcuugccagugcugguagagaagccugucaccucccaccacucucagcacuugucca

SEQ ID NO: 55858 - RNA, 69 nt, Homo sapiens
uggauugagaagcuguggcucaggcacagagaaagaugcccaguuccucccauccugcuucucugucca

SEQ ID NO: 55859 - RNA, 60 nt, Homo sapiens
uggauuucuauguugaccagucuagaccuuuugucuauucgauguuuacauagauguuua

SEQ ID NO: 55860 - RNA, 56 nt, Homo sapiens
uggauaguaauaaacauauaggugcagagguaucuuugugguaugauaauugucca

SEQ ID NO: 55861 - RNA, 76 nt, Homo sapiens
uggauauaauagaaugucaguauuggcuaaaaucguccaauguuucaggcucucuggucauucaaauuuuugucca

SEQ ID NO: 55862 - RNA, 85 nt, Homo sapiens
uggaucauauuauugaaaguugucaacaugaaacuguguuuuugaaaucaaaagugguuaaauauuggcaaucacaugugguuca

SEQ ID NO: 55863 - RNA, 58 nt, Homo sapiens
uggaaguggcagaggaagugguauaggaaaauuaaaucacuuugacggccaacuucua

SEQ ID NO: 55864 - RNA, 94 nt, Homo sapiens
uggaaguguauauuuguuuggaaucccagaucucagagucuucagcuaacaccuacugacacugcaacuauucacaggcaauauguacauucua

SEQ ID NO: 55865 - RNA, 65 nt, Homo sapiens
uggaauaagauaguggaagugggauuaaaaaauggaauuuguuccccuuucucuauuuuagcuca

SEQ ID NO: 55866 - RNA, 61 nt, Homo sapiens
uggaaucaugugcucuguggcauuuugugacuagcuuccuucacugagcaucaugguuuca

SEQ ID NO: 55867 - RNA, 67 nt, Homo sapiens
uggaauugaacuagaaccugcaaauuucaaugggaacaaaagguuaguaggauugguuuaccaucca

SEQ ID NO: 55868 - RNA, 70 nt, Homo sapiens
uggacagcaucccauucacagucacccuucuccauggaguggccauuggaaggugcacugugacagucca

SEQ ID NO: 55869 - RNA, 58 nt, Homo sapiens
uggacugagauuucagcugccacccauggcagguggcacagcuugcaauuuaagucua

SEQ ID NO: 55870 - RNA, 57 nt, Homo sapiens
uggacuguaauagagaacagaaagaugagucagaucagucuguggcuacugcagcca

SEQ ID NO: 55871 - RNA, 72 nt, Homo sapiens
uggagaagugauuugagggugaaaauaggguaagcguauuuacucuuuagcuccuuaaggaaugcuucuuca

SEQ ID NO: 55872 - RNA, 58 nt, Homo sapiens
uggagaugcacgagcagguggagcagcugaagcagagcauccaccgcgugcaccucua

SEQ ID NO: 55873 - RNA, 60 nt, Homo sapiens
uggcaagaccccaucucuacaaaaaacugaaaaauuagcugggagugguggucugugcca

SEQ ID NO: 55874 - RNA, 57 nt, Homo sapiens
uggcaagagauaugugucuauauucauucuucugcauauggauauccuguuuugcca

SEQ ID NO: 55875 - RNA, 55 nt, Homo sapiens
uggcagcagcaaauggcauaucaucuuccgugaucuuggagucaucaugcugcua

SEQ ID NO: 55876 - RNA, 91 nt, Homo sapiens
uggcauagaugaggagcuuaaagcuagcgcugcuuggaaggauuuuuaaaaaucuacagccagucugguuuguagcaucgguuuagggcca

SEQ ID NO: 55877 - RNA, 88 nt, Homo sapiens
uggcaugggguauuuaaugagucucucuggccagagagccuccucaagucucuggccagagacauucauuaaaguuacccagauacca

SEQ ID NO: 55878 - RNA, 79 nt, Homo sapiens
uggccacauuaggacuguguuucaaaagagcacaguggaaaaccacaaagcuucuugagacuuaggcuuuggaugguca

SEQ ID NO: 55879 - RNA, 87 nt, Homo sapiens
uggcaauuaaauauaacacuuuaauccaccuuaagaaucugaaagagauucucuguggaauggaaugauuguguaugaaucaugcca

SEQ ID NO: 55880 - RNA, 58 nt, Homo sapiens
uggccaucugaaaguuccugaugggcauucacccaucaggaaccuuuuugguguguca

SEQ ID NO: 55881 - RNA, 106 nt, Homo sapiens
uggccccugugcacguguggcucucagaggcuccaggucaugauuuccuuguggacaucccuugacguggagucucugggcccacuuaauucucccauaaaggcca

SEQ ID NO: 55882 - RNA, 66 nt, Homo sapiens
uggccucccaaaguguugggauuacaagugugagucaccgugccuggucccaugaacuuuagguca

SEQ ID NO: 55883 - RNA, 64 nt, Homo sapiens
uggccucuuugucucuugaucuuuguugguuuaaagucuguuuuaucagagacuaggauugcca

SEQ ID NO: 55884 - RNA, 78 nt, Homo sapiens
uggcuagaauaaagcaggcagaagaaggaggaaugagcagacuugcugaguucuggccuccauuuuucuccugugcua

SEQ ID NO: 55885 - RNA, 56 nt, Homo sapiens
uggcuagaugagauguacugcacguggcuucugcugcaggcaccuacaucuggcca

SEQ ID NO: 55886 - RNA, 78 nt, Homo sapiens
uggcugaguugucccaguuggguauugaauucaugguaugauuuauuugcaggauugggacuggauaaaacucaguca

SEQ ID NO: 55887 - RNA, 84 nt, Homo sapiens
uggcugcauaaaugucuucuuuugagaagugucuguucauaucuaucacccacuuuuugauggggagaacauuuuugcaaucca

SEQ ID NO: 55888 - RNA, 64 nt, Homo sapiens
uggcugcuguacagguuccauuugaaugcccugauagaggacuauggcaccugacagauagcca

SEQ ID NO: 55889 - RNA, 91 nt, Homo sapiens
uggcugggucaaaugguauuucuaguucuagauccuugaggaaucaccagacugucuuccacaaugguugaacuaguuuauggucccacca

SEQ ID NO: 55890 - RNA, 78 nt, Homo sapiens
uggcuucuaaacaaagagguaauaacaaagcuucucauuguguugcaaauuaagugaggugccuuuuauuagaaguua

SEQ ID NO: 55891 - RNA, 83 nt, Homo sapiens
ugggaacaaagucuguuacagcuauuucuguaggaaacugcuacacuccuuaccagaacggguguaacauuuuguaaguccca

SEQ ID NO: 55892 - RNA, 88 nt, Homo sapiens
ugggaccaccauuguauaugcgguccaucacugaucaaaacguuguuaugcagugcaugacuguauauuaucacaugugaucuuccca

SEQ ID NO: 55893 - RNA, 129 nt, Homo sapiens
ugggacuacaagccugagacacugugcuuagccaacucaccaugucuuuuaaacauucaacuuucaguuaaagggaacacucaagacauguuaugaggcugggcauaguggcucacgccuguaauccca

SEQ ID NO: 55894 - RNA, 61 nt, Homo sapiens
ugggaggaaggugcuaggccuugaguagcaggaagacaaugggucuggcuucuuuguucca

SEQ ID NO: 55895 - RNA, 105 nt, Homo sapiens
ugggaggaugguuugagucugggagguggagguugcagugaugaagugagcugugauugcaccacugcacuucagccuuggcuacagaguaagaccguuaucuca

SEQ ID NO: 55896 - RNA, 84 nt, Homo sapiens
ugggaguacaggggaagaauauuaggggauuucggagugguaaccagacuaagugaaaaacuaauguuuuucucuguacucuca

SEQ ID NO: 55897 - RNA, 63 nt, Homo sapiens
ugggaguugggcagaacaaguggcuugaguguguccuggacuuguuuguccugcccuuucuca

SEQ ID NO: 55898 - RNA, 69 nt, Homo sapiens
ugggauacaagcagagguagggugugcaguuucugagaagugcauugcaucucugcuucaauccuccca

SEQ ID NO: 55899 - RNA, 75 nt, Homo sapiens
ugggauuucuaguucuagacccuugaggaaucaccacacugucuuccacaaugguugaacuaguuuacucuccca

SEQ ID NO: 55900 - RNA, 61 nt, Homo sapiens
ugggcauaauuacagcauuguuuuuggaagauuccauguaauaaagucugaagugugcuua

SEQ ID NO: 55901 - RNA, 57 nt, Homo sapiens
ugggcugagaguaccuuauaaacagggacagugugucuuaaaaagugcucaggccua

SEQ ID NO: 55902 - RNA, 75 nt, Homo sapiens
uggggaagaaaaaacuagguuuguggccaaaaguaaucauauaauaggccugauaagccuuuucuuucugcccca

SEQ ID NO: 55903 - RNA, 76 nt, Homo sapiens
uggggaucuagagcggugcugggggauguuaacugguguucucugguuguaucucacaccccucucauauacccca

SEQ ID NO: 55904 - RNA, 69 nt, Homo sapiens
ugggggcacugaguauguuuagaaguaaaggaagaaguucugaacuguaugaacaauuuauauucccca

SEQ ID NO: 55905 - RNA, 84 nt, Homo sapiens
ugggucaaaugguauuucuaguucuagaucccugaggaaucaccacacugucuuccacaaugguugaacuaguuuacagaccca

SEQ ID NO: 55906 - RNA, 84 nt, Homo sapiens
ugggucaaaugguauuucuaguucuagauccuugaggaaucaccacacugucuuccacaaugguugaacuaguuuacucuccca

SEQ ID NO: 55907 - RNA, 82 nt, Homo sapiens
ugggucaacugguauuucuaguucaagauccuugaggaaucgccacagucuuccacaaugguugaacuaguuuacaguccca

SEQ ID NO: 55908 - RNA, 64 nt, Homo sapiens
uggugagaaaugagaugcuuuuuuucaaagacugagaaaaacccagagacgucuauucucacua

SEQ ID NO: 55909 - RNA, 91 nt, Homo sapiens
ugguggccagaacauuaucacuuugauaguuuaaauggcauugaccaauguauuugaaucagguacaaguuugaagauuuucugguuauua

SEQ ID NO: 55910 - RNA, 72 nt, Homo sapiens
uggucauagguugggcguuugauuuuauggcuuuuaggaagcaaaaaaaaucagcgaccuugcuugagauca

SEQ ID NO: 55911 - RNA, 77 nt, Homo sapiens
uggucuauggccuguaaacuagagacccuggaaagcuggugacauaguuccaguccaaguuugaaggcccaagacca

SEQ ID NO: 55912 - RNA, 62 nt, Homo sapiens
uggguuaagggaauguuguagcugguuugaucuacucaaaccacuaaaacuuucucuuucca

SEQ ID NO: 55913 - RNA, 130 nt, Homo sapiens
uggguuuaaaucccaccucuucuuauaauaucuucaaagugacaaaguugcagcaucuacugcauaggaaccaauaaugauaauguggcaacuuugucauuuuguaaaugaggguacugauacacaccua

SEQ ID NO: 55914 - RNA, 83 nt, Homo sapiens
ugguacuuuuagaagugcuaagaaguggauuuugcaaugacucaugacacuguagcaccucuuuggccuuucguaaaguauca

SEQ ID NO: 55915 - RNA, 62 nt, Homo sapiens
uggguaagugcacaaaucuuaaauguacaucggcgauguauuuuuacaugugcauccaccca

SEQ ID NO: 55916 - RNA, 77 nt, Homo sapiens
ugguauuuguugcagcagcacuaucauuucuuaguaccaaauucugucuuagauaauguugcuauaacaaauuacua

SEQ ID NO: 55917 - RNA, 82 nt, Homo sapiens
ugguuuggugagcaaggguaggggccagagggaaguagaugaauagucuugccacaucccuuucccacccuucacagggcca

SEQ ID NO: 55918 - RNA, 77 nt, Homo sapiens
uguaaacuugccaggcaccaaaguaugcuuuaggauaucaccaugacuagugcccuuugcugccugccaugguuaca

SEQ ID NO: 55919 - RNA, 95 nt, Homo sapiens
uguaaagacauguuuuggauaaaguuugugagaaaaaaauucaagcugcuucuauuuucauacaagcuacaaucacaaagaguuuugccuuugca

SEQ ID NO: 55920 - RNA, 68 nt, Homo sapiens
uguaaagguguuucacuguuguuuuaauuuacaauucccuaauuauauaugguaguagcaccuuuaca

SEQ ID NO: 55921 - RNA, 76 nt, Homo sapiens
uguaaugaucaaaucagaguaauugagaucuucaucaccucaaagcuuuaucuuuacuuugugugggaacauuaca

SEQ ID NO: 55922 - RNA, 63 nt, Homo sapiens
uguacagugucucucaguuugggaucaucugauguuauuuaaugauuagagagaggcugugca

SEQ ID NO: 55923 - RNA, 60 nt, Homo sapiens
uguaccaauuugagagccucaagcaucaccuuuguaugagucuguucucacauugcuaua

SEQ ID NO: 55924 - RNA, 82 nt, Homo sapiens
uguaccacaugcacaucuuuuuagucucacauuugcucaacacagauggacagaaaaaaauagauguauguuuuuggguaca

SEQ ID NO: 55925 - RNA, 72 nt, Homo sapiens
uguacccuaacacccuucagcuuucuuagcucagaggcauuuugagguauggauaucuggagaggaaguaca

SEQ ID NO: 55926 - RNA, 82 nt, Homo sapiens
uguagccuuguaguauaguuugaagucagguagcgugaugccuccagcuuuguucuuuuggcuuagaauugucuuggcuaua

SEQ ID NO: 55927 - RNA, 66 nt, Homo sapiens
uguagcuucuccuuucauucccuguagaaucugucuuguucucauggagucaggagcagaaauaca

SEQ ID NO: 55928 - RNA, 60 nt, Homo sapiens
uguauagccacuauuaaagcugcaauugacuaggaauuuuggcuauuucuguggcauaca

SEQ ID NO: 55929 - RNA, 77 nt, Homo sapiens
ugguggugcacaucuguguuccagcuacucaggaggcugaggcaggaggauggcuggagcccagaaguucaaggcca

SEQ ID NO: 55930 - RNA, 64 nt, Homo sapiens
ugguguauuuagaccuuauauacauuaaauguaauuggugauauguuaggaucuaagucugcca

SEQ ID NO: 55931 - RNA, 60 nt, Homo sapiens
ugguugaaguggaaauugguucaauuuuggaaaacaguuuggcaguaucuacuacagcua

SEQ ID NO: 55932 - RNA, 96 nt, Homo sapiens
uguauccaagauauuuccaaggagaguacauuuuuacuuuuucaggugcuaugauuaaaccucuuaacaguguauuccuuuggacagaggcauaua

SEQ ID NO: 55933 - RNA, 86 nt, Homo sapiens
uguaugauagguuauuauggcauuauuguucuugcuggauauucauggaaguaggaauuuaauguaugauaauacaucaauguaca

SEQ ID NO: 55934 - RNA, 65 nt, Homo sapiens
uguaugcacacguguccaugugcacccauguccaagucaccucucugcacggcugugugugugca

SEQ ID NO: 55935 - RNA, 108 nt, Homo sapiens
uguuggcccuuccuggguccugaguuugcagaccuuuggacuggaacuauaccauuggcucuccugagucuccagccugcugguugcagaucuuaggauuugucagca

SEQ ID NO: 55936 - RNA, 67 nt, Homo sapiens
uguucuaaggaguagaggaauagcaaugaauguuuucauugcuucauuuuuguuauuuuccaggaca

SEQ ID NO: 55937 - RNA, 62 nt, Homo sapiens
uguucucacuuauuugugggagucaaaaauuaaaacaauugaacucauggagaaggagaaua

SEQ ID NO: 55938 - RNA, 55 nt, Homo sapiens
uguucuuacucauaugugggagcuaaagauauuguucucauggagggaaagagca

SEQ ID NO: 55939 - RNA, 117 nt, Homo sapiens
uguucuuuuaagagggacucagcagucaggggagauggcaaugcgaugaugacugagugucuuagucuuuuuuguauugcuaugcaauaucugaggcuggguaauuuauaaagaaca

SEQ ID NO: 55940 - RNA, 74 nt, Homo sapiens
uguggcuaguggaauuaagaaacugaauuuuaaauuguauuuaguuuuaauucauuuaaauuucaauagccacg

SEQ ID NO: 55941 - RNA, 80 nt, Homo sapiens
uguggcugucugacuaggggcccuggcuucuuacuggcucugaacuggaaguggccaucagguccuagcagccacccaca

SEQ ID NO: 55942 - RNA, 89 nt, Homo sapiens
uguggggauggcaugaccuuguccucagugucauccagaaaggaugagggggacaggugucauagcaggaguauuaguucauucucaca

SEQ ID NO: 55943 - RNA, 86 nt, Homo sapiens
uguggguacaaaacagguguauuuucuguagagaauuuugaaacaauaauaaagaugacugaaagguauacgcuuguuauccuaca

SEQ ID NO: 55944 - RNA, 71 nt, Homo sapiens
uguggguggagggaaggacuggacuaaggcaagggggagcaaaguucaguccauuuccuuggucacucgca

SEQ ID NO: 55945 - RNA, 89 nt, Homo sapiens
uguggguuaauugauacacauuuuuauauauuuaaggggagcauaugcuauuuucuuaaaugcauagaauguguagugaucaaguuaca

SEQ ID NO: 55946 - RNA, 71 nt, Homo sapiens
uguggaaucccaagauaauuuguuuguagauggauaccuaguuugcauauucgaguuauuuugggaccaca

SEQ ID NO: 55947 - RNA, 66 nt, Homo sapiens
uguggcaguuuuaaauaugaaaacacccccuguauguauuggguguauuuauauuuaaacucuaua

SEQ ID NO: 55948 - RNA, 90 nt, Homo sapiens
uguucagauuuuaaaauaacuucuacagaauauguuugagguauuuucuuaaugaacuuuauuuuguagagaaguuuuagguucccagca

SEQ ID NO: 55949 - RNA, 58 nt, Homo sapiens
ugugucugggcaggguaauuuugaaugacaucauucaaagugcauguucccacuugca

SEQ ID NO: 55950 - RNA, 62 nt, Homo sapiens
uguguguauuugagauauugugaaauauauauuugguuuucaucaauacuucuuggcauaca

SEQ ID NO: 55951 - RNA, 64 nt, Homo sapiens
uguguguguguggacaggcaggguggggagggauaaacacauuaaaaauguccaaauaaauaca

SEQ ID NO: 55952 - RNA, 73 nt, Homo sapiens
uguguucaaaguaaagccucaggauggauucaaaagggaagagaauugauaagagggauacuuuagaaauaca

SEQ ID NO: 55953 - RNA, 126 nt, Homo sapiens
uguuacaguccccaacauuauucaguagaauacugaauauaguuaacaguauauuacaguacuacuggcuguacuauacuguaacuguauucaguauucugcugaauacuguaggcaauuauaaca

SEQ ID NO: 55954 - RNA, 74 nt, Homo sapiens
uguuacuguacugaauacuguagacaguuguaacacaauuguuacacaaugguaaguguuuguguauugaaaca

SEQ ID NO: 55955 - RNA, 70 nt, Homo sapiens
uguuagaugccauagcagaauuuggucaagucucuuagugcagggauuuggauggaguuguuaugugaca

SEQ ID NO: 55956 - RNA, 90 nt, Homo sapiens
uguuauauuugcaugggcuacauuuuuucauccugucacuuucaaucuacaugugucauugaaucuaaaaugagucucuuguagacagca

SEQ ID NO: 55957 - RNA, 71 nt, Homo sapiens
uguuaucaucagccauacaacguaugcauguaugccugaugcuaacauauguuguaugguugaugguaaca

SEQ ID NO: 55958 - RNA, 68 nt, Homo sapiens
ugugacauuuuuacugaugagaguucuaguaacaguuaacucaaguuuucuccuacagaagagucaca

SEQ ID NO: 55959 - RNA, 66 nt, Homo sapiens
ugugagaugauagauauguuaauuugcuuuaaaguagcaaugauuuuacugucuguguaucucaua

SEQ ID NO: 55960 - RNA, 67 nt, Homo sapiens
ugugaguggaaaacauaugcuuguugaauuaaguaaugaucaauccuaugcucuguuuuuacucaua

SEQ ID NO: 55961 - RNA, 69 nt, Homo sapiens
ugugaugugcauguguaugugcaugugauguuguauguucaucauguguucaucacagcacaauucaca

SEQ ID NO: 55962 - RNA, 65 nt, Homo sapiens
ugugauguguuuuguaguucaacucauuucccuuuaggaccucaguagacacuaaauacauuaca

SEQ ID NO: 55963 - RNA, 60 nt, Homo sapiens
ugugauuaaguuaacaauguugaguggugggauuauucacaugggugcaauauaaucaca

SEQ ID NO: 55964 - RNA, 70 nt, Homo sapiens
ugugauuaaguuaggauuuugagauagagaaauuauccuauauuaucuuggugggcuuaauauaauuaca

SEQ ID NO: 55965 - RNA, 84 nt, Homo sapiens
ugugauuucccggagcaucucauucccauuacuucaaaaauagcacagaacuguucugauggcacagugaguuccagggauaca

SEQ ID NO: 55966 - RNA, 61 nt, Homo sapiens
ugugcaaucagcuucauuacauuuuucagcaccuuuaggaacuguagugggaguugacaca

SEQ ID NO: 55967 - RNA, 66 nt, Homo sapiens
ugugcacaugguagguauugaguaugugaauuauugaacauguacuuuagauaaauuaugugcaca

SEQ ID NO: 55968 - RNA, 60 nt, Homo sapiens
ugugccacugcaccuggccuaaggaaguaguagaauucuuauaaggaaugcagaggcaca

SEQ ID NO: 55969 - RNA, 60 nt, Homo sapiens
ugucuggaguaugaaccauguaucagcaccgaaagguucuagaagucagacuuucgggca

SEQ ID NO: 55970 - RNA, 76 nt, Homo sapiens
ugucuguauaaaaaucacuuugcuacaaggcaguuaguuacuaaucugaccaaccggcuggagugaaggugagaca

SEQ ID NO: 55971 - RNA, 65 nt, Homo sapiens
ugucuuuaacauuggcuacauacagaacuuuguuaaacaugugcacugcagcaauguaaaagaca

SEQ ID NO: 55972 - RNA, 59 nt, Homo sapiens
ugucuuuaagcaaacaguguuuguguaaccaccuuguagcaacauucagcuugaagaua

SEQ ID NO: 55973 - RNA, 116 nt, Homo sapiens
ugucuuuuucuuuauaaauuaccagucucagguaugucuuuaucagaaaugugagaacagacuaauaugagggcauacucagugaggugaagaguuugugcaaaggcagagaggca

SEQ ID NO: 55974 - RNA, 59 nt, Homo sapiens
ugugaacagaauuagucaccuaaucacaggagugacuucgaucccagguucuguucaca

SEQ ID NO: 55975 - RNA, 60 nt, Homo sapiens
ugugaauggugcugcaaugaacauacacaggcaugugucuuuauaacagaaucauuuaua

SEQ ID NO: 55976 - RNA, 58 nt, Homo sapiens
uguccagggauggggucagggacggguuuggcuguugccuagaugcugcccugggaca

SEQ ID NO: 55977 - RNA, 72 nt, Homo sapiens
ugucuaauuuugccuugacacuuacaguccaacaaaaaauuuauaggaaaaauaucacagguaaaguugaca

SEQ ID NO: 55978 - RNA, 68 nt, Homo sapiens
ugucuaucgaaguucacaauguacuuuccauuuuauucuuauguauuauggaacuuaauugauggaca

SEQ ID NO: 55979 - RNA, 57 nt, Homo sapiens
ugucaucccuaaaguugaggugauaauuacaguacuugccuuaacauugggaugaua

SEQ ID NO: 55980 - RNA, 66 nt, Homo sapiens
ugucauugguucuguuuaugugauggaguauguuuauugauuuacauauguugaaccagucuggca

SEQ ID NO: 55981 - RNA, 66 nt, Homo sapiens
uguccuaacaugcacucugugauuuggaauggugaguauugcagcuugcaggguguguaaagggca

SEQ ID NO: 55982 - RNA, 86 nt, Homo sapiens
uguccucuggaguaaugguuggcuauucuacuugauagugguugaacaucaucauuaaucaggcaaugcuugcuacccacagggca

SEQ ID NO: 55983 - RNA, 107 nt, Homo sapiens
uguccuggagccccugcaccugucuccaaaugguauccgcugugccgccaggacgcgcuucacuggcagcaugggugccuuugugaagauugugaggcgcuaggaua

SEQ ID NO: 55984 - RNA, 129 nt, Homo sapiens
uguccugugagccucuaaagcagugguuuucauuccggagugauuuuaacuuccagcaauguccgaagacauuuuuagucgucaaagcauuccgggaagaggagcaugcuacugacaucuaguggguag

SEQ ID NO: 55985 - RNA, 78 nt, Homo sapiens
uguaugugugguuuaagaauugaauucuggaaagauaccggaauugcauaaacacauuucuuaugaccugcguauaca

SEQ ID NO: 55986 - RNA, 56 nt, Homo sapiens
uguauguguuuuauguguguuuaaauaaauauguuagauacacguguauacauaca

SEQ ID NO: 55987 - RNA, 93 nt, Homo sapiens
ugucacuugccucauccaaucugcugacuuuagaacccaaaaaguuucuuugguaugggcuuuuggagcugaauuacaguggagggcaugaug

SEQ ID NO: 55988 - RNA, 79 nt, Homo sapiens
ugucaggcauuguucuagaaacuggaguuacauguugaguagaagagauaaacaccauucucuguaacaagaacugaca

SEQ ID NO: 55989 - RNA, 63 nt, Homo sapiens
ugucaguuucuugagauggaacgcacuccugcugaagaugcugugaccaucuuugagaugaca

SEQ ID NO: 55990 - RNA, 57 nt, Homo sapiens
uucagggacuuuagacaagagaggacacaggauugcuucucccucuggggcccuggg

SEQ ID NO: 55991 - RNA, 99 nt, Homo sapiens
uucaaagcucucuuucagccgggugagguggcuuguuccuguaaucccagcacuuaugggaggccgaggcaggccaucgcuugagcccaggagcuugag

SEQ ID NO: 55992 - RNA, 61 nt, Homo sapiens
uucaaaguguugguuuugggcugggcgcgguugcucaugccuguaaucccagcacuuuggg

SEQ ID NO: 55993 - RNA, 94 nt, Homo sapiens
uucagaaaugauuguuagaauguagaauggaacugacuauagcugacuuggcucagcugaugggaguucuguguuaaaugacaaagauucugga

SEQ ID NO: 55994 - RNA, 58 nt, Homo sapiens
uucagaguagagcgacuucuccugcaaccaaguuuuaagagagguuuucuaugaugag

SEQ ID NO: 55995 - RNA, 57 nt, Homo sapiens
uuauuuauauucaguguggaucucugagcaugguucaagcacauugaguguguguga

SEQ ID NO: 55996 - RNA, 60 nt, Homo sapiens
uuauuuggucuguaauuacauggacuuuauuuggaggucagugaaggaacaacuaaauag

SEQ ID NO: 55997 - RNA, 97 nt, Homo sapiens
uuauuuguuuauuaucuguuggguuauugcuggaucccuagucucuagaacagcacuuguuuucauaguagucacuuaauaaauaauacauggauga

SEQ ID NO: 55998 - RNA, 98 nt, Homo sapiens
uuauuuuacuucagugaaucagagugaugguuuaaguauugcacaagggcacuucaugugaugcaugccacacuuuggauucugcaugggagagauaa

SEQ ID NO: 55999 - RNA, 56 nt, Homo sapiens
uucaagucaacaagcacuugagaguucucauguuuuuuaagagcuugaaauuugga

SEQ ID NO: 56000 - RNA, 57 nt, Homo sapiens
uucaagucaaggaaagaggucugagaagaacaacucugccaucaccuugaucuugga

SEQ ID NO: 56001 - RNA, 68 nt, Homo sapiens
uucaauaacuauguuugaguauccauuagcacagacccuaugugagauacuagagauauaguggugaa

SEQ ID NO: 56002 - RNA, 89 nt, Homo sapiens
uucaauacgugagccucaaagucuucucauuaugucuuccacauauuaaaguggaaguaaccagaaggcuuuggaaauucaggucugaa

SEQ ID NO: 56003 - RNA, 56 nt, Homo sapiens
uucacagugugaucuaugggcaaugugcugcuacaccaccauguuucaccugugaa

SEQ ID NO: 56004 - RNA, 60 nt, Homo sapiens
uucacguucugccaugauuguaaguuuccugaggccuccccagucaugaagaacugugag

SEQ ID NO: 56005 - RNA, 57 nt, Homo sapiens
uuacuguauagaaucaucuugaaugcuaccagugcuacacgggaugcuauaugguga

SEQ ID NO: 56006 - RNA, 80 nt, Homo sapiens
uuacuuaaccucucugagacuugguauuguaaucugugaaaaggaaauaaucacaguguucuugugaggguuaaauguag

SEQ ID NO: 56007 - RNA, 62 nt, Homo sapiens
uuacuugagauggggugucacuauguuggccaggcuggucucgaacuccucaccucaaguga

SEQ ID NO: 56008 - RNA, 67 nt, Homo sapiens
uuagaacaguguuugccucgcucucacucacucucauaaaugcuagugauggucaugcacugucuga

SEQ ID NO: 56009 - RNA, 75 nt, Homo sapiens
uuagaauucaacaguaaagcauuuuuaaguggcuacauggcuauucuaaaguuuuauuuauugugucaauuuuga

SEQ ID NO: 56010 - RNA, 78 nt, Homo sapiens
uuagauaaaugaggauaguguugaaggcaggaggggauucuccuguucugccccagccuugucgugcuucccaucuga

SEQ ID NO: 56011 - RNA, 70 nt, Homo sapiens
uuagauuggugcaaaaguaauugugguuuuggcugaaaaguaaaugcacaaagauuuugcacuaaucuaa

SEQ ID NO: 56012 - RNA, 106 nt, Homo sapiens
uuagauuugacugccuuuuaguuuacaggugaaugcucacauucuaaucagagaagaugauugggauauaaagcauucucagaaaccaggaaguaugcauuucuga

SEQ ID NO: 56013 - RNA, 66 nt, Homo sapiens
uuagcauaagggcaagcucuuuaguguccuucaaagcacauauguaaauagcugccuguguacuaa

SEQ ID NO: 56014 - RNA, 77 nt, Homo sapiens
uuagcuugacuguuuuugguguauaaaaaugcuagugauguuugcacauugauuuuuauaucuuaagacuuugcuga

SEQ ID NO: 56015 - RNA, 57 nt, Homo sapiens
uuaggccuuugauuggggugcucugugcuacagguagugccaaaucgagggcucuga

SEQ ID NO: 56016 - RNA, 93 nt, Homo sapiens
uuaggcggcgaacucuuauuguugccaugcuuucauuugaaccauggagaaauggcaaaucagaggcauggacaaaaucauagagcuacuuga

SEQ ID NO: 56017 - RNA, 58 nt, Homo sapiens
uuaggcuuauauucccaucagaacaucugguacaacugguggaagauaaguagccuga

SEQ ID NO: 56018 - RNA, 56 nt, Homo sapiens
uuagggaguaaucuaaaaaugguccuugggacuuuuucuaugauugauuccucuag

SEQ ID NO: 56019 - RNA, 80 nt, Homo sapiens
uuagguaggugcaaaaguaauagcgguuuuuaccauuauguucaauggcauaaaccaccauuacuuuugcaccaaccuaa

SEQ ID NO: 56020 - RNA, 65 nt, Homo sapiens
uuaggucuuaagucuuuaaugcauuucgagugauuuauuguguauguuguaagacuuagaccuag

SEQ ID NO: 56021 - RNA, 67 nt, Homo sapiens
uuauuagguuagugcaaaaguuauugcaguuuugcuauuaaaaguaacuuuugcaccaacccaauag

SEQ ID NO: 56022 - RNA, 77 nt, Homo sapiens
uuauuagguugguggaaaaguaacugccauaacuuuuaauggcaaaaaccacgaguacuuuugcaccaaccuaauag

SEQ ID NO: 56023 - RNA, 60 nt, Homo sapiens
uuauuagguugguggaaaaguaauugugguuuuugccauuacuuuugcacaaccuaauaa

SEQ ID NO: 56024 - RNA, 129 nt, Homo sapiens
uuauuauauagguaaacuguaucauggagguauggacuacagauuauuucaucagccacauaauaagcaaaauacucgagagguaguuuuuuggucgucucccuccugccacacuccacccucaaguag

SEQ ID NO: 56025 - RNA, 82 nt, Homo sapiens
uuauucagucucggguaugucuuuauagcaguguggaaauguacuaauucaccagcuaaaaagaguauguuuggacuaguag

SEQ ID NO: 56026 - RNA, 62 nt, Homo sapiens
uuauucauuaauugcuaagguuugaaagcaaccaagauguccuucaguggguuaauggauaa

SEQ ID NO: 56027 - RNA, 110 nt, Homo sapiens
uguuuuauggguguauguuucucccugucccugugaccguggagaaaaaagugcuaaauaaucaugggguaaaggcacaggggacacaucaagauaauuuacauagaaca

SEQ ID NO: 56028 - RNA, 75 nt, Homo sapiens
uguuuuuugacuuuuuaacaauagccauucuaacuaguaucuuggaaugguaucuuguugggguuucaauucgca

SEQ ID NO: 56029 - RNA, 87 nt, Homo sapiens
uguuuagugacucuguguguaauaccuuugacuauauguggagaaccaugaaugaaguugguuguuugcucauaaguucacuggaca

SEQ ID NO: 56030 - RNA, 66 nt, Homo sapiens
uguuuauuggaugacuagaaaugucaacuuucauuagcaaagugaauguuugguccuuuauaaaca

SEQ ID NO: 56031 - RNA, 66 nt, Homo sapiens
uguuucuaguucuagauccuugaggaauccccacacuggcuuccacaaugguugaacuaguuuaca

SEQ ID NO: 56032 - RNA, 56 nt, Homo sapiens
uguuucuuacguuuuuagaggcuucgugacggaguuaucagagacauugagaggca

SEQ ID NO: 56033 - RNA, 83 nt, Homo sapiens
uuaaagaaaaccuuguauagguggcaaaacugaaauuuaaaguacugcaauuguuucaguagcauugcuuauacagucuuuaa

SEQ ID NO: 56034 - RNA, 61 nt, Homo sapiens
uuaaagugaucauaaggauagucugucuggugauggacuagcacuucuaugagcauuuuag

SEQ ID NO: 56035 - RNA, 58 nt, Homo sapiens
uuaaaguggugggauuccaggcaugagccaccaagcucagucuucucuacuauuuuaa

SEQ ID NO: 56036 - RNA, 64 nt, Homo sapiens
uuaaccauuaagggucaggaaauugacuuccuccuggacacuggcuuggcuuucuugguguuaa

SEQ ID NO: 56037 - RNA, 67 nt, Homo sapiens
uuaagaaauaaaugguaucggcauuuguguauaguucuuuguaugcaaaugcugcuauuucucuugg

SEQ ID NO: 56038 - RNA, 60 nt, Homo sapiens
uuaaggaaggagucuuaaaugggugccuacuuugugcacuuagacucucuuugucuuuaa

SEQ ID NO: 56039 - RNA, 58 nt, Homo sapiens
uuaaggggaccugugagaguacaggugaaccaagcaucagauucuacaggccuuuuga

SEQ ID NO: 56040 - RNA, 59 nt, Homo sapiens
uuaauauauuaugugguuucccuauccaaugaacuuggauagggcuuguugauaguuaa

SEQ ID NO: 56041 - RNA, 65 nt, Homo sapiens
uuaauguaucuaucacaucacauaguuaccaauuuguauauguguguaugugguaagaacauuaa

SEQ ID NO: 56042 - RNA, 94 nt, Homo sapiens
uuaauuugucugcaugauuggugagcagagggagaaguaaauuugucgcgaaagcuucauucuucuguuuuaacaacucacaaagagaaauuaa

SEQ ID NO: 56043 - RNA, 81 nt, Homo sapiens
uuacaugauuaucucagugaauguggaaaaagcauuggaaaaacuucagcauccacucaguucacugagauaaucauguaa

SEQ ID NO: 56044 - RNA, 60 nt, Homo sapiens
uuacauuuccccauauugagaaccgaauuucucaagucaguuugggagaagcuauuguaa

SEQ ID NO: 56045 - RNA, 68 nt, Homo sapiens
uuagugugcaaguauuaaucaucuagccaauaaugaccaaaucuaguugaaaugcaugugcacauuaa

SEQ ID NO: 56046 - RNA, 57 nt, Homo sapiens
uuauaacuggggaguuccuugaauggaaauauguucacaguggcugcuuaauuguga

SEQ ID NO: 56047 - RNA, 86 nt, Homo sapiens
uuauacagaaucaugcauuaagagaacaugcacauaaggcaaaaugaugacugcauggccuuuaaaugucacagaguacugucuaa

SEQ ID NO: 56048 - RNA, 77 nt, Homo sapiens
uuauacagcugguaaguggcagagauucuggaggcagacugccugcauuugaauucugucgcuuacuagauguauga

SEQ ID NO: 56049 - RNA, 102 nt, Homo sapiens
uuauacuuuaaguuuuaggguacaugugcacaacgugcagguuaguuacauauguauacuugugccauguuggugugcugcacccauuaacuugucguuuaa

SEQ ID NO: 56050 - RNA, 56 nt, Homo sapiens
uuauagcagcauaaauggacuaagacagagucuuaaaucaguuugggcugcuauaa

SEQ ID NO: 56051 - RNA, 62 nt, Homo sapiens
uuaucagcagagucauacuucaaaaauuauaaaguauuuuuguuaggugguuuguugacuga

SEQ ID NO: 56052 - RNA, 67 nt, Homo sapiens
uuaugaagccuguguugaauuauagaaauaaaauuuuaauuauguuuacauuaacauggcuuuguag

SEQ ID NO: 56053 - RNA, 88 nt, Homo sapiens
uuaugauaguuuacugagaaugaugauuuccaauuucauccaugucccuacaaaggaaaugaacucaucauuuuuuauggcugcauag

SEQ ID NO: 56054 - RNA, 99 nt, Homo sapiens
uuaugauauuaugcuugugacuggauguacagucaguauuuguguguaaauuuaaauauauaaauuucauguguaugugcaguuaauauucauucauga

SEQ ID NO: 56055 - RNA, 83 nt, Homo sapiens
uuaugauuuuuaugguuuauuuguaagcagagugcugucccaaaauggaugaaccuguuuaccaguaaaucaguaaacuguaa

SEQ ID NO: 56056 - RNA, 55 nt, Homo sapiens
uuaugcagcaaagugcuugaaacauaaccaaugcuucacuugcacguuugcauag

SEQ ID NO: 56057 - RNA, 62 nt, Homo sapiens
uuauggcaaaugaaagaaagccagucucagaaggcgaugggcugggugauucauuuccauaa

SEQ ID NO: 56058 - RNA, 59 nt, Homo sapiens
uuaugucuuugagcaaugcuguguccccugauagaaaggcacucucuauaaagacauga

SEQ ID NO: 56059 - RNA, 76 nt, Homo sapiens
uuauguuauauuggcagaagagaagaugauagcugugaaaaauguagccuucuuugauuuuguuacuaagacauga

SEQ ID NO: 56060 - RNA, 67 nt, Homo sapiens
uucucuacgugucaaggagaagcuaaaggaagcaauugcuauuaccuuuuuaagacagguuagagga

SEQ ID NO: 56061 - RNA, 71 nt, Homo sapiens
uucucuaugucuuucauauuuuggggauggugcuuuguccugugaccucaauuuucugaaggauguaagaa

SEQ ID NO: 56062 - RNA, 57 nt, Homo sapiens
uucucuguggauugggugagaggcaggagaucagccucagagaaccuaagcggagga

SEQ ID NO: 56063 - RNA, 68 nt, Homo sapiens
uucugcuguuguuuuuguugaagguguuuucugauccaaauaaagugucacaaugaacagcagcagaa

SEQ ID NO: 56064 - RNA, 60 nt, Homo sapiens
uucuggggguauuuugauuuguggacguggagaaagugguagagagcaauaccuccagag

SEQ ID NO: 56065 - RNA, 56 nt, Homo sapiens
uucuccucuuuggacucguugaccuuaguuaaugaugucauagucuaagaugagaa

SEQ ID NO: 56066 - RNA, 68 nt, Homo sapiens
uucuucuuaauguccugggaacuaucugugcagacuaagaauaauuuguuccuuaggcauuggaagaa

SEQ ID NO: 56067 - RNA, 55 nt, Homo sapiens
uucuucuuaggugaugaagaggucauuuuaacuucuacagccaguucaggaagaa

SEQ ID NO: 56068 - RNA, 65 nt, Homo sapiens
uucuuuuaauugugggggagugugaguugcuuacguccuuacucaaaucccucagaauuauagaa

SEQ ID NO: 56069 - RNA, 113 nt, Homo sapiens
uucuuuucuucuugaggucccaaaauaucuugagguuccuggaccugcuagaaagugucauucuuuauuuaucacaggucaggaaucuugcaagggaaccauaagacaaggaa

SEQ ID NO: 56070 - RNA, 97 nt, Homo sapiens
uugaaaauguaagagcauaaaagcuggauuucgcauccuguuaggguauuuuugguccuaucagagaugggaagucagcuaauaauugcauauuuag

SEQ ID NO: 56071 - RNA, 60 nt, Homo sapiens
uugaaagacagaggggcaaguuggauuaaaaagcgagacccaacuguaugcugucuucaa

SEQ ID NO: 56072 - RNA, 62 nt, Homo sapiens
uugaaagcuaucagagauuccauaauguaaugaugagcaaucuggacucugaaagcuaucag

SEQ ID NO: 56073 - RNA, 64 nt, Homo sapiens
uugaaauaucucgucuucuacguuucuuuaagggaagcuuugaaguagaaagacgaaauuuugg

SEQ ID NO: 56074 - RNA, 115 nt, Homo sapiens
uucuggugccuucccuugaagcagucugggguauugcacacagaaucaggguaagggauuuggcuuccccuguguguaagugcgcuaggcccauuguaagcagagagcaguggaa

SEQ ID NO: 56075 - RNA, 83 nt, Homo sapiens
uucugguuucucuggugaugaacaggaccauaaugcuccaaagagcuuaugucuuuuguguucagcuaccagggcagguagag

SEQ ID NO: 56076 - RNA, 108 nt, Homo sapiens
uucuguaaauggugauuggguucccagaccuaucuauaaaagugaauccagcccacaguguauucacuuuuauagacaggucugggaacccgaucaccacguauagaa

SEQ ID NO: 56077 - RNA, 84 nt, Homo sapiens
uucuguaagaugaggaagaguuagcagggaaaaggggaggaaaggcuuggagcccugagaaaacuuuguccuuauguuggggaa

SEQ ID NO: 56078 - RNA, 72 nt, Homo sapiens
uucugucucuauggauuugccuauucuguauuucauauaaauagaagcauaauucagccacaagagauggaa

SEQ ID NO: 56079 - RNA, 84 nt, Homo sapiens
uucuguuuucccucuacauaaauguaugccugucagaugggucaagacguacaauguauauuuuacuguaggcugaagucagag

SEQ ID NO: 56080 - RNA, 67 nt, Homo sapiens
uugaagagaguaguggaucuuccauaacggaguuugagaucugagaauggaaagacugccucuucaa

SEQ ID NO: 56081 - RNA, 67 nt, Homo sapiens
uugaagagguagucugucccuuagcagagcucgaacgcugugcugggagauccacugcucucuucag

SEQ ID NO: 56082 - RNA, 62 nt, Homo sapiens
uugacagaccuuggucauauccucugacucaccaucuucucugugacccucagguuugucaa

SEQ ID NO: 56083 - RNA, 79 nt, Homo sapiens
uugaccaaguaaagacugagaauagaucuugaagaauauggugaaaaucuucauaguucuuuuagucauuauuugucaa

SEQ ID NO: 56084 - RNA, 62 nt, Homo sapiens
uuccaggucuuccugaauggauuccucuccccauuguggaauauuacagagaggaccuggga

SEQ ID NO: 56085 - RNA, 86 nt, Homo sapiens
uuccauuaaagucugaucccuuuuuuaaauagcuguuuggcuaaucuguugugguagacacuguugaaaaggccccacuuucggaa

SEQ ID NO: 56086 - RNA, 59 nt, Homo sapiens
uucuacaggcuguucaagaagcauagcucugacaucagcuucugggaaugccugaagaa

SEQ ID NO: 56087 - RNA, 84 nt, Homo sapiens
uucuagaaggcaaugauggagguagauuguccauaauaaagggugugaugggcccucucuacuuuuaucagagcacagcuggaa

SEQ ID NO: 56088 - RNA, 80 nt, Homo sapiens
uucuagcaccugcgguguuggcguugucaugggaauucugcaggcuuuagacaacugaaacacugugcaacugugcagaa

SEQ ID NO: 56089 - RNA, 66 nt, Homo sapiens
uucuaugcuaugcuauuacucagaaguuaauauugauauuaacaucuagaguuuuggugcuaagaa

SEQ ID NO: 56090 - RNA, 59 nt, Homo sapiens
uucucaauggcaacuuguugcuuggauucucaucagaagcaaauaauugucuuugaggg

SEQ ID NO: 56091 - RNA, 60 nt, Homo sapiens
uucucacggcccugcgcacuggcauuuuccaccuguaaugcguggcaggagccgugggga

SEQ ID NO: 56092 - RNA, 69 nt, Homo sapiens
uucucagauggggccaaguccuucugugaagccaaaaaucuuucauggaggauuugcuucuuuugagga

SEQ ID NO: 56093 - RNA, 84 nt, Homo sapiens
uucucagcuugacuuuucccuuuagcuuagugauuuuggggcacucaaggaacacugcagacagaggggcacguuuugugggaa

SEQ ID NO: 56094 - RNA, 56 nt, Homo sapiens
uucucaggguacagucagaauguagauuaugucucaauucaaguaugccuugagaa

SEQ ID NO: 56095 - RNA, 73 nt, Homo sapiens
uucucagguauagauaaaucugugugauauggauguuuaagaauaaauaucacagcauugucuauaauaagaa

SEQ ID NO: 56096 - RNA, 69 nt, Homo sapiens
uuccgggucuggcacagggaaaguacaagauaagcucuggugcaucuuauugugccacaaaauaaggaa

SEQ ID NO: 56097 - RNA, 68 nt, Homo sapiens
uuccuacaaaguacuguuuaaauugcagaacaauuuccaguuccacuguagcaaaaaguacuuaggaa

SEQ ID NO: 56098 - RNA, 99 nt, Homo sapiens
uuccuauaaggauccuaucacaguugcauauuuaaggacuacgaaaugaacguauuuuaaggcaugaacugugacuaaaugauggggcagggauaggag

SEQ ID NO: 56099 - RNA, 93 nt, Homo sapiens
uuccuauugcuccuuuuguugcuauuuagcaccugugcacaccaggcauuagucggugcauugggagucagugcugaacaaaggggguaggag

SEQ ID NO: 56100 - RNA, 85 nt, Homo sapiens
uuccucaagauugcuuuggcaauucagauucuuuuauaguuccauaugaauugugugaaaaaugccuuuggaguuuugauaggaa

SEQ ID NO: 56101 - RNA, 61 nt, Homo sapiens
uuccuugugacuaguagugaccacguggccagccaauguagcacagccagugaugaaggga

SEQ ID NO: 56102 - RNA, 61 nt, Homo sapiens
uuccuugugcaggguacuugccagcccuuuacaguauggcagcuguguccuucguaaggaa

SEQ ID NO: 56103 - RNA, 81 nt, Homo sapiens
uuccuuuccuauauguguauauccuauuaguucuguccuucuggagaacccuaauauagaauguacagagaagaaaaggaa

SEQ ID NO: 56104 - RNA, 114 nt, Homo sapiens
uuccuuucuuccugccaaacaaauccagugauugugaaaaaccucucguggaagguucaagcauguuucaauaaaugaaggauuuuaauucagugaauuugcagaaacaaggaa

SEQ ID NO: 56105 - RNA, 78 nt, Homo sapiens
uucaguuuccauguaguugagcaguuuugagugaguuccuuaauccugaguucuaguuugauuacacuguggucugag

SEQ ID NO: 56106 - RNA, 64 nt, Homo sapiens
uucaguuugccaguacuuuguuguggauuuucucaucgauguucaucagggauauuggccugaa

SEQ ID NO: 56107 - RNA, 113 nt, Homo sapiens
uucauacagggccuuguguguaguuguagcucauuaauucucagugcagugcaaauauacagcauucacuguugaugggcaugcagguggucgccaguuugggcuauuaugaa

SEQ ID NO: 56108 - RNA, 62 nt, Homo sapiens
uucaucuggcaauucagagauuuauucuuggugcggauuuauuucuggagagcuagugugaa

SEQ ID NO: 56109 - RNA, 83 nt, Homo sapiens
uucauuauucacuccauuucauuuuagcucuugaagucaaaaugggauuccaaagagcaaaauagaaguuuggagaguuugaa

SEQ ID NO: 56110 - RNA, 77 nt, Homo sapiens
uucauuuaauaaaguucugcuggcauauaugauguuucucuaaauugguugcuacuuaggagcuuuauucuaaugga

SEQ ID NO: 56111 - RNA, 128 nt, Homo sapiens
uuccaaaguugcucccacauugucagguuaucuuuauagcaguaccccaguauccugguaccaauuuccuguauuagucuguuuucauacugcuaaaaagaacuaccuaagacuggauaauuaaugaa

SEQ ID NO: 56112 - RNA, 79 nt, Homo sapiens
uuccaacacuauguugguucuguuuauaugcuggauuacauuuauugauuugcacauguugaaccagcaaaaacuggaa

SEQ ID NO: 56113 - RNA, 77 nt, Homo sapiens
guacugcagacauguggauggagguguggggagugaguuagacagcuuugggcccugaccuccauucugagcagugc

SEQ ID NO: 56114 - RNA, 107 nt, Homo sapiens
guagagggauuagaggaauaauucuuuuugucuguuuggugucaugagggggacaggaaguuguucggugucaugagggggacaggaaguuguucagucccauuugc

SEQ ID NO: 56115 - RNA, 92 nt, Homo sapiens
guagagguugaggugauuugucugcaggaauaguggaacuagacagggaaaugauuuauuacucuaaugacaaaugaucaacaaacuucugc

SEQ ID NO: 56116 - RNA, 76 nt, Homo sapiens
guagcaaauacgugauauugcaguauauaggaaagaaugagcacuuucauuauuguaaacaucuguacauugcuac

SEQ ID NO: 56117 - RNA, 61 nt, Homo sapiens
guagcagaaugaguguucaaacccagacuguuuggcuuuggagugugcucauaacugcuac

SEQ ID NO: 56118 - RNA, 56 nt, Homo sapiens
guaucauacuguuuugauuacuguaucccugugguauaguuugaguagugugaugc

SEQ ID NO: 56119 - RNA, 77 nt, Homo sapiens
guauccccucagcuuuuguuugucuaagaaauauuuuguuguuucuucaugcuugaaauaauagcugugcaggguac

SEQ ID NO: 56120 - RNA, 66 nt, Homo sapiens
guauccugagggaggggagggaucaucagaguuggaagagugaugccuuuuuguccucaguuauau

SEQ ID NO: 56121 - RNA, 80 nt, Homo sapiens
guaucuccgagcucccagagaguugcuguagugagugcugaaugucuauggcacuaguacuggaaagcaauguggagugc

SEQ ID NO: 56122 - RNA, 92 nt, Homo sapiens
guaugcaagauggccucagccaucucuuagggauucacuacaguuggauguggaauaaacuagagaggacugagagcccugcuuuggcguau

SEQ ID NO: 56123 - RNA, 76 nt, Homo sapiens
guaguugugaugguuauguaagaagaauccauguuguacucuaagcauuaugucuugcacaaauuauuuuaacugc

SEQ ID NO: 56124 - RNA, 74 nt, Homo sapiens
guaguuuaauuaggucccaugugucaauuuuaauuuuuguugaaauugcuuuugaagacuuagucauaaauuau

SEQ ID NO: 56125 - RNA, 72 nt, Homo sapiens
guauagacaugcacauggcuaacuuuuuucuguauuuuuuguagagacaggguuucgccauguugcucauac

SEQ ID NO: 56126 - RNA, 107 nt, Homo sapiens
guauauaugguauaaagggugauuagacaguguguguauauaugguauaaagggugauuagacuguguguguauauaugguauaaagagugauuagacuguguguau

SEQ ID NO: 56127 - RNA, 58 nt, Homo sapiens
guauauauuauacauuauauagcauguagugauguaugauguaauguaugauauguac

SEQ ID NO: 56128 - RNA, 58 nt, Homo sapiens
guaggauaugaggauuuuaagacagucagcuuauagcuguuuugcucuuuauaccuau

SEQ ID NO: 56129 - RNA, 87 nt, Homo sapiens
guaguaaugguuguauaauauuuugggugugcuuaaugccacugaauuacacacuuaagacacuuaaaauguuacauuuuauucuau

SEQ ID NO: 56130 - RNA, 87 nt, Homo sapiens
guagucaagagaucauaugcaguaaugaacucuauggaagaggauuaaauaugacauucauuugguaaaugauuucuguaugauuau

SEQ ID NO: 56131 - RNA, 64 nt, Homo sapiens
guagugcaguuugagaaucagugggugacagcagauacacagggguuccaaagcuugcaguuac

SEQ ID NO: 56132 - RNA, 111 nt, Homo sapiens
guaguuauguucuaauaaaacuauuuacaagcacaggcagcaggcuggauuucaucugcagguguaguuugcugaccaugguuuagaguauguguucugggauguggcugc

SEQ ID NO: 56133 - RNA, 112 nt, Homo sapiens
gguucguucucuugaaaauugaaagcagaguuuuuaguaauuccuuucugagaugaugaggguuuagauaaggaguaucauauuaaaacuaagcuucaagagaaccaggacc

SEQ ID NO: 56134 - RNA, 71 nt, Homo sapiens
guaaauggauauugccaucuccuuuuaaaauuaugcauuuaggaaagaauaggagaggcaguuuccuuugc

SEQ ID NO: 56135 - RNA, 73 nt, Homo sapiens
guaaauuuucagucuguguguacauuuauagaugaacuauguuuauuguaaucaacacaucauugggaauugc

SEQ ID NO: 56136 - RNA, 73 nt, Homo sapiens
guaaauuuucagucuguguguacguuuauagaugaacuauguuuauuguaaucaacacaucauugggaauugc

SEQ ID NO: 56137 - RNA, 79 nt, Homo sapiens
guaacaaagggagcugcauaaucuuguggucuguucugagcuccaugcacaggauaaugcagcuccugauacugauugc

SEQ ID NO: 56138 - RNA, 58 nt, Homo sapiens
gguuuugagcagagaagugcccugcgcugcagcagcugacagccaggcucugcaaacc

SEQ ID NO: 56139 - RNA, 74 nt, Homo sapiens
gguuuuggagugauaugguuauaugggaugcccauguaaacagggacccuuuaaccauggcacucagcaggacc

SEQ ID NO: 56140 - RNA, 78 nt, Homo sapiens
gguuuggguaagucagauuuacaaugucagccaucaucuggccauguuugaaagucuaggcuuacaguaaugcaagcu

SEQ ID NO: 56141 - RNA, 118 nt, Homo sapiens
gguuuucaaagugagucuuggaccaugauguuaaacuuuuguuuucccugagauuaauagcugucucaauuuagggcuuguuuaacuaucauuaauguccaaacucuccaacaaaacc

SEQ ID NO: 56142 - RNA, 88 nt, Homo sapiens
gguuuuccucauguuucuugucauugcaguaagagugggcucuugaaguuucccaagggucuuacuuuccuguagucaugggaaggcu

SEQ ID NO: 56143 - RNA, 126 nt, Homo sapiens
guaaacaagcuguugucauacuugaguccuugaguauugaauuugagcugucucuuagugacaauaccaaguagauaguuggauauucaaaucuggggcuuaggcagaggccagggcuauguauau

SEQ ID NO: 56144 - RNA, 58 nt, Homo sapiens
guaaacugaucugaaggccaggcucuccugggaugcuugcaaaucagaucaaguuuac

SEQ ID NO: 56145 - RNA, 64 nt, Homo sapiens
guaaguaaguaagagguauuacaugcugucauagcagaauauaccucuuacuuucagcacuuac

SEQ ID NO: 56146 - RNA, 61 nt, Homo sapiens
guaagugauagaucugggauucagaaccaggucuccuuuccccaggauucuguuacauuac

SEQ ID NO: 56147 - RNA, 55 nt, Homo sapiens
guaauaacuguggaaaaagguuuuugcagucgcuuaucugugccacuguuauuac

SEQ ID NO: 56148 - RNA, 67 nt, Homo sapiens
guaauaauuugcuaccuggugggauauugugagguugagugaaucaucagugcuugcaaauuauuau

SEQ ID NO: 56149 - RNA, 64 nt, Homo sapiens
guaaucucaccuacuugggaggcugaggcgggagaaucgcuugaacccaggagguggagauugc

SEQ ID NO: 56150 - RNA, 64 nt, Homo sapiens
guaaucucagcuacucaggaggcucaggcaggaaaaucacuugaaccugagagguggagguugc

SEQ ID NO: 56151 - RNA, 64 nt, Homo sapiens
guaaucucagcuacucaggaggcugaggcacuagacucgcuugaaccugggaggcggagguugc

SEQ ID NO: 56152 - RNA, 58 nt, Homo sapiens
guaaucucagcuacucgggagacaggagaaucgcuugaaccugggagguagagguugc

SEQ ID NO: 56153 - RNA, 64 nt, Homo sapiens
guaaucucagcuacucgggaggcugaggcaggagaauugcuugaaccugggaggcagagguugc

SEQ ID NO: 56154 - RNA, 64 nt, Homo sapiens
guaaucucagcuacuugggagccugaggcaggagaauugcuugaacccgggagguggagguuac

SEQ ID NO: 56155 - RNA, 64 nt, Homo sapiens
guaaucucagcuacuugggaggcugaggcacaggaaucucaugaacccaggagguggagguugc

SEQ ID NO: 56156 - RNA, 64 nt, Homo sapiens
guaaucucagcuacuugggaggcugaggcaggagaacugcuugaauccaggaggcagagguugc

SEQ ID NO: 56157 - RNA, 64 nt, Homo sapiens
guaaucucagcuacuugggaggcugaggcaggagaaucgccugaacccaggaggcggagguugc

SEQ ID NO: 56158 - RNA, 64 nt, Homo sapiens
guaaucucagcuacuugggagguugaggcaggagaaucccuugaacccaggaggcagagguugc

SEQ ID NO: 56159 - RNA, 62 nt, Homo sapiens
guaaucucagcuacuugggagguugaggcaggagaaucuagaacccaggaggcggagguugc

SEQ ID NO: 56160 - RNA, 64 nt, Homo sapiens
guaaucucagcuacuugggagucagaggcaggagaaucacuagaacccaggaggcagagguugc

SEQ ID NO: 56161 - RNA, 64 nt, Homo sapiens
guaaucucagcuucuugggaggaugaggcaugagaauugcuugaacccaagagguggagguugc

SEQ ID NO: 56162 - RNA, 68 nt, Homo sapiens
guagggguaaauucuggacuuugccauugcauuuguaaaugucauggcacugaugagaguuuccuuac

SEQ ID NO: 56163 - RNA, 63 nt, Homo sapiens
guauguggaguguaugugacagagaggaauaagauguuaucucuguccucugcuuuccauagc

SEQ ID NO: 56164 - RNA, 64 nt, Homo sapiens
guauuaguuuucuguggauuacaagcaagucacacauuuugaauguacucaaggaaaacuaugc

SEQ ID NO: 56165 - RNA, 65 nt, Homo sapiens
guauugcacauggcaggugcucaauuauuacugaaugaauaaggaagccuggauuauugcaauau

SEQ ID NO: 56166 - RNA, 130 nt, Homo sapiens
guauugcuuuagcuauuuauggucuucuguuguucuauacaaaauuuaggauuuuuuccauuucuguggagaauguaauugguauuuugauagagauuacauggaaucuguagauugcuuuggguaguac

SEQ ID NO: 56167 - RNA, 116 nt, Homo sapiens
guauuguauccaacaugcuuguguauguaugucuauuauguagcaggaagguuuuccccgaacaucuauucugcuaucaugcuggaccagguaaacaagcucuuuauaugcaauau

SEQ ID NO: 56168 - RNA, 70 nt, Homo sapiens
guauuucuaguucuagauccuugaggaaucaccacacugucuuccacaaugguugaacuagcuuuuaugc

SEQ ID NO: 56169 - RNA, 66 nt, Homo sapiens
guauuucuaguucuagauccuugaggaaucaccacacugucuuccacaaugguugaacuaguuuac

SEQ ID NO: 56170 - RNA, 81 nt, Homo sapiens
gucacaguucacacuuugcgcuguauucccuuguuagacucaagaucucaacagugggcacuguaaauguggaauggugac

SEQ ID NO: 56171 - RNA, 66 nt, Homo sapiens
gucacauuccuauuuucaucuuccuugguguuucuagcacuggaaguaaccaugaauggaauugac

SEQ ID NO: 56172 - RNA, 86 nt, Homo sapiens
gucacuacauuuuauuuugaugcuagauggauguguaggaauaucuuaucauugccucaaucuguauuuuucugaaauguagugau

SEQ ID NO: 56173 - RNA, 68 nt, Homo sapiens
gucauuauaucauugccauggaaagggguggugacucuccgguguugccauggcaaugguaaacugac

SEQ ID NO: 56174 - RNA, 71 nt, Homo sapiens
gucauuaugcuccaucuugucaguaaucuucuuguuaaagagcacucguugacaugaugagcaauaauggc

SEQ ID NO: 56175 - RNA, 62 nt, Homo sapiens
gucauuguauuuaacucgaaagggauuguagaaggcacaucucauuccuugaaaauaaugac

SEQ ID NO: 56176 - RNA, 85 nt, Homo sapiens
gucagguugcgcacugcaugaggauacucagucaaugggccaaguguucgcugagaugcuccucuugcaaagccuuuugcuuggc

SEQ ID NO: 56177 - RNA, 105 nt, Homo sapiens
gucauaguuguaaccaaacugaauaacaugcuuuguuuaugacuuucuuugagcauuuguagcagagcauauucauucggggagggaauauuuuacaauaaggac

SEQ ID NO: 56178 - RNA, 58 nt, Homo sapiens
gucacuggcugucuuguaugauuuaacugacaguucuuuauccaugcaguacagugac

SEQ ID NO: 56179 - RNA, 62 nt, Homo sapiens
gucacugucuacuguaauagccccauuuaaaaaauguugaugugccuuagagagacggugac

SEQ ID NO: 56180 - RNA, 84 nt, Homo sapiens
gucagacauuuuauuagcaccaugguagaauaaugguagauaacagucuuccauuauuaguacugugguggaauaacagucccc

SEQ ID NO: 56181 - RNA, 79 nt, Homo sapiens
gucagaugguggauuauuucgauuccugauuaaaaucuuuacagcuccucaauaucuauggaauagucuacacucugac

SEQ ID NO: 56182 - RNA, 76 nt, Homo sapiens
guccucugauagaucugggcaaaguaaaucaaaaacuuucuggaaaagauuuaccauuuuagaugcuauuaaggac

SEQ ID NO: 56183 - RNA, 120 nt, Homo sapiens
guccugagcagcggcugaaugggcucuaccugugacucaccguuccucuccugguaggcagcaacaauaugggugaggucguagucauaggcaaaggggcuggucccguugaucacggau

SEQ ID NO: 56184 - RNA, 80 nt, Homo sapiens
guccuugagauuaucuugaucuugaaaguugcuggccuuugagcaacuucuucaaacccucaagaugcauccccauggac

SEQ ID NO: 56185 - RNA, 82 nt, Homo sapiens
guccuugcuauugugaauggugccgcaauaaacauacgagugcaugugucuuuauagcagcaugauuuauaaucguuugggc

SEQ ID NO: 56186 - RNA, 72 nt, Homo sapiens
guccaugauuuucugcacuauggaaguauuauuuaacaaauuuguguccacaguggauuaaaguuacuggac

SEQ ID NO: 56187 - RNA, 72 nt, Homo sapiens
guccaugggaaauaguuauugagauuaauauuauuauuaugcuauugauuaauugugauuaggcagguggac

SEQ ID NO: 56188 - RNA, 80 nt, Homo sapiens
guccauuuuacugaugagaaaacuaaggcacaaagaaauuaaggaacuugccugagaucauacuguuaguaaguaaggac

SEQ ID NO: 56189 - RNA, 76 nt, Homo sapiens
gucccauuccaucuugcauuugcuaaaaugcauuuggaaucacauuauuauagauuaugcaagauuggaagacggc

SEQ ID NO: 56190 - RNA, 69 nt, Homo sapiens
gucccuuaagcuauagugaauaaauugcacaauaaaugagcaaggaucuauaaacauagcuccaggggc

SEQ ID NO: 56191 - RNA, 57 nt, Homo sapiens
guccuaccuggaggaacucaggacugcagggacagcugagaagaaacagguaaggac

SEQ ID NO: 56192 - RNA, 59 nt, Homo sapiens
guccucagugugcuuauuucggcuugcuccaugguuugcgguagcauagacugcaggac

SEQ ID NO: 56193 - RNA, 66 nt, Homo sapiens
ggucuuacaguaugaguaagaguucucugaacagacagagggaacuugaauguacuggcuaggacc

SEQ ID NO: 56194 - RNA, 113 nt, Homo sapiens
ggucuucucacucugucacacccugguuggagugcagcuugugcgaucagcagugagccaugauugcacaucugcacuacagccugggugugacagugugacacacaaagauc

SEQ ID NO: 56195 - RNA, 73 nt, Homo sapiens
ggucucugcucgucuaauauugguguguaggaaugcuugcaauuuuugcacauugauuuuguauccugagacu

SEQ ID NO: 56196 - RNA, 76 nt, Homo sapiens
ggucugcagcaaccucaauucuugcuuccucaggagaaaaaauucaacugaaggacauaaggcagagugagagacc

SEQ ID NO: 56197 - RNA, 60 nt, Homo sapiens
ggucuaaugaggagaaaaaaggaaagagaucaauucagaucuccuucauuccuuuggacc

SEQ ID NO: 56198 - RNA, 75 nt, Homo sapiens
ggucguguuauugaaggacauucuaugguagaugagucccucaucacagguauguucuuucaaaggaucaugacc

SEQ ID NO: 56199 - RNA, 55 nt, Homo sapiens
gguccagaggcuucauuaagacuuucgacugaauguggagugaagguucuggacc

SEQ ID NO: 56200 - RNA, 79 nt, Homo sapiens
gguccuaauggaggacaaugucaccuucagauggugugugcaucucuggaggacguguccaccaugaaagauuuggacu

SEQ ID NO: 56201 - RNA, 69 nt, Homo sapiens
ggugagaacagauggcuuuauuaugccgaauuguccaauucaucaacaugguaugccucuguauuuauu

SEQ ID NO: 56202 - RNA, 59 nt, Homo sapiens
ggugacagagugagguccugucucaaaaaaggagggagagagucaucucuaucuguacc

SEQ ID NO: 56203 - RNA, 64 nt, Homo sapiens
ggucuuuguugucuuucguauggaacacuacaaguugguccuuuccauuggagacacucagacc

SEQ ID NO: 56204 - RNA, 69 nt, Homo sapiens
ggugaaaagaugagcaccauacacagcagccuggccauuggucauguguauggugcuaaucuuuucacc

SEQ ID NO: 56205 - RNA, 67 nt, Homo sapiens
ggugaggguugagcuggaauucacacccacaucugggaggugcaaauuccagcucaacuccugcacc

SEQ ID NO: 56206 - RNA, 55 nt, Homo sapiens
ggugccaggagagggcaggagggcuacagccuuucaccugcuguucuuuugcacc

SEQ ID NO: 56207 - RNA, 71 nt, Homo sapiens
ggugauggauauaucuauuacauugaccauggugacaguuucacaaguguauagacauguccaaucucauc

SEQ ID NO: 56208 - RNA, 61 nt, Homo sapiens
ggugaugguuaccacaaauuauaagauaggaaaccucucuuuuggguauggagccaucauu

SEQ ID NO: 56209 - RNA, 57 nt, Homo sapiens
gguucugcaggaaacagaacaaggauuaauuauugaugucugucuccgaguagaauu

SEQ ID NO: 56210 - RNA, 104 nt, Homo sapiens
gguuaggacauauaguauuauuugauagacacauauccaugugaaaaaucaguugacacgugagagggcgaugugucuauuucauaugucuagguuugucaacc

SEQ ID NO: 56211 - RNA, 82 nt, Homo sapiens
gguuaucaagcagugcauaggaucuaaaauuugauuuccuuaaguucaaauucuggaucuaugacuuauuagcuggguggcc

SEQ ID NO: 56212 - RNA, 72 nt, Homo sapiens
gguuauuuucauagauaaagauaguaauagagaagaugaauaucuguuacugcucuuuugucaugaguaauc

SEQ ID NO: 56213 - RNA, 78 nt, Homo sapiens
gguuauuuuuaugcagacauuguuccaaccacaacgacuguuuucgaaggugggugguauuuguuugguggaaggauc

SEQ ID NO: 56214 - RNA, 70 nt, Homo sapiens
gguguuucugguucuagaaccuugaggaaucaccacacugucuuccacaaugguugaacuaauuuacacu

SEQ ID NO: 56215 - RNA, 81 nt, Homo sapiens
ggugucucuguggcccuaggguagggcucuacugcagcccuaggguagagagcuaggccacuggggcuuccagauugcacc

SEQ ID NO: 56216 - RNA, 69 nt, Homo sapiens
ggugugugugugugcgugugcucaugcaugcacaagugaauuugcauacacaagcauacauguaccacc

SEQ ID NO: 56217 - RNA, 75 nt, Homo sapiens
gguuggugcaaaaguaauugcaguuuuuaccauuaagaguaauggcaauaaaaugcaguuacuuuugaaccaacc

SEQ ID NO: 56218 - RNA, 84 nt, Homo sapiens
gguuguaugaacuugaaaaaucccuugcucucucagacccucaguauggggucuggaaaaauaagggggacauacucaauagcc

SEQ ID NO: 56219 - RNA, 64 nt, Homo sapiens
gguuguggaagugaacaaccaaggcaggugguacugccauuuccugauagaacacuuuccaauc

SEQ ID NO: 56220 - RNA, 55 nt, Homo sapiens
gguugugguuccauuuguauucagucaauauggaggcaaauggaucccacaagcc

SEQ ID NO: 56221 - RNA, 102 nt, Homo sapiens
gguuuauuauagauuuagggaguacaagugcaguuucguuacaugugaauauugcguaguggcgaagucugggcuuuuagugcagccaucacuaguguagcc

SEQ ID NO: 56222 - RNA, 62 nt, Homo sapiens
gguuucuuugccaccaguggucuuggggagcccauccuuccaagacuagggagcagaaagcc

SEQ ID NO: 56223 - RNA, 57 nt, Homo sapiens
ggugggcauuccaaugguuaaaacucucauaaguagugacuagggauaugugccacu

SEQ ID NO: 56224 - RNA, 83 nt, Homo sapiens
gguguauaccuucccuguguuaugguuucuaauguccagggcggaagaggauauuacucccaauaucgcagggggcguacacc

SEQ ID NO: 56225 - RNA, 76 nt, Homo sapiens
ggugcaaggaugcuuggcccacccugagaggcguaauucgcccaucaacauugcugucaggcaucuuuuuagcacu

SEQ ID NO: 56226 - RNA, 60 nt, Homo sapiens
gguggaaccauauggaauugccaauacuuugacguacaaaaauggcaauaugguucuacc

SEQ ID NO: 56227 - RNA, 72 nt, Homo sapiens
gguggaauuauguuaagggucuugagguagggggaucaccuuggauucuccugguggacccuaaacgccauc

SEQ ID NO: 56228 - RNA, 85 nt, Homo sapiens
guucuuuucaugaugaaacuguuauguaucuugauugggugguggugauccuaugacucuaugcauguuucacaauucaaagaac

SEQ ID NO: 56229 - RNA, 61 nt, Homo sapiens
guugaaucauuucuugucuucaguuuucucagaagaacugaaacaaugagagauacauaac

SEQ ID NO: 56230 - RNA, 68 nt, Homo sapiens
guucuucugagaucaugucugugcuguucuucuacaucaugagguacaagcagucagauccagagaau

SEQ ID NO: 56231 - RNA, 74 nt, Homo sapiens
guugagugcaauucaggggagguggcuaugagaauuucaaucauggaaaucuaaguuuggauugagaucucagc

SEQ ID NO: 56232 - RNA, 104 nt, Homo sapiens
guugauacaaguaauuaaacauuuguccaaauccaugggauguacagaaucaagagugaagccuaauguaaacuauggacuuugggcaauaauuaugugucaau

SEQ ID NO: 56233 - RNA, 58 nt, Homo sapiens
guuccuuaacaguuuccucucauucagacacaacuucaaugaagugaaguuagggaac

SEQ ID NO: 56234 - RNA, 80 nt, Homo sapiens
guucagcugaugaagaacgggaaacaaauugcuuaauuuuaagaaauggcaaauguuuucuguugaaauguuuacugaac

SEQ ID NO: 56235 - RNA, 124 nt, Homo sapiens
guucuggguauagucugcaguccagagugagaacuuauggugauuuuuucaggccugucuauggccucccaaagaccagucagcaugagcuuccucccuucugagcccauaaagaccccagaac

SEQ ID NO: 56236 - RNA, 66 nt, Homo sapiens
guucaaguuuucucuuguggguuauacugugucccuuaauuuucagaggagagcaaagcuaugagc

SEQ ID NO: 56237 - RNA, 56 nt, Homo sapiens
guuauugcaguauagaggucuaagcaccaauucuuagaucauauacuugccaugac

SEQ ID NO: 56238 - RNA, 69 nt, Homo sapiens
guggcuuucaagugaccgucuuuugucauugaacuucaaguugacagugagaugucaugugaaaguuau

SEQ ID NO: 56239 - RNA, 66 nt, Homo sapiens
guucaguuugugaucauugucaaauaguguuuauuaagcauuuaccuauguguuacaaugcuggau

SEQ ID NO: 56240 - RNA, 65 nt, Homo sapiens
guucauccaugcaguaucaguacuucauuccauuuuaugacggaauaauauugcauuggauggau

SEQ ID NO: 56241 - RNA, 57 nt, Homo sapiens
guucauguuuucuuucacuuugucaguguaucacaugaagugaguguuaaacugaac

SEQ ID NO: 56242 - RNA, 71 nt, Homo sapiens
guuccagcuuauagguagauuuaaaauuugucugguuggcaauugguugaguuuaucuaaagaccugggau

SEQ ID NO: 56243 - RNA, 62 nt, Homo sapiens
guucccaccuuguuuguucuguggcuuccaggagggaagacuuggaccagagagguggggac

SEQ ID NO: 56244 - RNA, 62 nt, Homo sapiens
guuccuauucuagacguuccauauauggaauuccacagauggaaugccauuuauaauggaau

SEQ ID NO: 56245 - RNA, 77 nt, Homo sapiens
guuccugagcugggaagucaauauuucgcaccucaggcccugcugaguggaagaccagacuuuccaacaucaggaau

SEQ ID NO: 56246 - RNA, 69 nt, Homo sapiens
guuaagucugugggaugggcuuugagucuguguauuugggggcuaaagcuuagauccaugguggcugac

SEQ ID NO: 56247 - RNA, 86 nt, Homo sapiens
guuacuucucuguggcaguuuguuugugagguccagauuauguuacuaucuaucucacagguaacuguaggcucacaugagagaac

SEQ ID NO: 56248 - RNA, 63 nt, Homo sapiens
guuagcaguauggagcgaggcccagauccagacuucugucggccuaauuuuauaucuguggac

SEQ ID NO: 56249 - RNA, 66 nt, Homo sapiens
guuauagaaggaucuaaaugguaucccauauucaggcacagacacauugcagauccuucaaaugac

SEQ ID NO: 56250 - RNA, 89 nt, Homo sapiens
guguuuucccuuggauuuagcaauagccugcaucugcagcuuguuugaaggacuguuuggaggacuaugcucaggccauuggagcacac

SEQ ID NO: 56251 - RNA, 74 nt, Homo sapiens
guguuuaagacuuagcuagguuuccauuuagaucuucauaucuguugcauggaagaaaguuggguucuuggcau

SEQ ID NO: 56252 - RNA, 64 nt, Homo sapiens
guguuucuaguuagauccuugaggaaucaccacacuguuuuccacaaugguugaacuaguuuac

SEQ ID NO: 56253 - RNA, 119 nt, Homo sapiens
gugugcaugcaauaaauacauuauauauuuuuucuggcaauaggcagugucccaauaguaacacccuguugugcucuuauugugcagggaauauauuauuugguuaauuauuagcacac

SEQ ID NO: 56254 - RNA, 101 nt, Homo sapiens
gugugcauguguggugugaguguaugugcacauauggugcauaagugccuguguggggugguguacugugaugugugauguaugaaucuauguaugugcau

SEQ ID NO: 56255 - RNA, 73 nt, Homo sapiens
gugugccaucaaaguaucucaauaugguagaauuuuuucuccuuuguggaaauacuuguggugccauguacau

SEQ ID NO: 56256 - RNA, 57 nt, Homo sapiens
guguugggauuacaggcaugagccacugcaccuggcccuauguaguuuucucaauau

SEQ ID NO: 56257 - RNA, 127 nt, Homo sapiens
guguugguuauaugauguuuuccauucugaggauuuugccuuuuuaaaaguauaggccuggcauaaauuugaagaguauaggccuggcauaaauuuuuauguaaagauuaaggguggugauuaauau

SEQ ID NO: 56258 - RNA, 108 nt, Homo sapiens
guguagauuucagauggucaaggugccaugagggagggguggugccgcacaacagugcugucauucauccuuuccuuucagcaucuuaugacgguuugcaguuuauau

SEQ ID NO: 56259 - RNA, 66 nt, Homo sapiens
guguagccuaaguguacaguguuuauaaagucuacaguaguauacaguaaugucuuaggcugucac

SEQ ID NO: 56260 - RNA, 58 nt, Homo sapiens
guguauaucacaguacccucugaaaauacaguuuugagaacuaaaaugugguauauau

SEQ ID NO: 56261 - RNA, 89 nt, Homo sapiens
guguaugacagcuaaauuguuaaauccaaggucaugaagcuuuauccuuauguuuucuucuaaggguuucacagguuuagcucuuacau

SEQ ID NO: 56262 - RNA, 75 nt, Homo sapiens
guguauggaggugguuuugguuuggcuacaacagagaacugcugacucauucagaguagaaacacuuccauaugc

SEQ ID NO: 56263 - RNA, 66 nt, Homo sapiens
gugguguaucacacuuauugaccugcagauguuaagccacccuugcaucucuggugugaaacccac

SEQ ID NO: 56264 - RNA, 62 nt, Homo sapiens
gugguugcuuugugccaccauuauuccugacucugaauuuugaugcuaccuaaagcaaccau

SEQ ID NO: 56265 - RNA, 81 nt, Homo sapiens
gugguuucucaaaccucuuaauggccuguaaucuuucaacaguuaagaguauugcuaauaagagauuugagaacaauuugc

SEQ ID NO: 56266 - RNA, 62 nt, Homo sapiens
gugggguuucugagccuguuagaaagugacauucuuuacuuaucacaggucaggaaccuugu

SEQ ID NO: 56267 - RNA, 60 nt, Homo sapiens
guggguauucguuguagccauuuucuuuuccuagucaagguuuggacagugauuauccau

SEQ ID NO: 56268 - RNA, 84 nt, Homo sapiens
guggguguguuugugggggucuguauguguaugcaugucuacauaaacagacauauaugcauacccucaccaacuacacacuac

SEQ ID NO: 56269 - RNA, 61 nt, Homo sapiens
guggucccagcacuuacacaucugagccagcucaggcuggauggaaaguuuugagggccac

SEQ ID NO: 56270 - RNA, 74 nt, Homo sapiens
guggucucuaaguagaggaaucauuuugugcauuguuuccagagccaccagauuuacuuuacuauuagaaucau

SEQ ID NO: 56271 - RNA, 77 nt, Homo sapiens
gugucauuuauguauggaagucaguuuguuggcucuaaaccugaggcuuacauuuucuuucauauuuuaaaugcuac

SEQ ID NO: 56272 - RNA, 57 nt, Homo sapiens
guguccucgaguacacaucagggucucagccucggccacgugugucugugaguacac

SEQ ID NO: 56273 - RNA, 66 nt, Homo sapiens
gugucuuguagacaauguauaguuuuaguuugguguuuugcuguuauuguuguuguuuugagacac

SEQ ID NO: 56274 - RNA, 117 nt, Homo sapiens
gugugacuaggacgccucugugcauggauuuuaagauugugauguucagcagugugacuaggacgccucugugcauggauuuuaagauugugauguuuagcagugugacuaggacgc

SEQ ID NO: 56275 - RNA, 67 nt, Homo sapiens
gugugauuguuaauuuuaggugucaacuuuccuggauuaaggaauaccugaagagcuaauaaagcau

SEQ ID NO: 56276 - RNA, 95 nt, Homo sapiens
guguguacauuugggggauugggagagaaggauggauaaggggagaggcagagagauugucacccuuuauccauuuccucuuuugugugcuccac

SEQ ID NO: 56277 - RNA, 68 nt, Homo sapiens
guguguggguguguaucugugugugugugcaugcacaugcauaugcacgugcauacacacuugugugu

SEQ ID NO: 56278 - RNA, 70 nt, Homo sapiens
guguguguacaugcaugcaugggugugcgugcauaugucugcauauguauacgugugugugugcgcgugc

SEQ ID NO: 56279 - RNA, 68 nt, Homo sapiens
guguguguguguacaugugugcaagugcaugucaauguacacauaugugcacauuuacauauauacac

SEQ ID NO: 56280 - RNA, 77 nt, Homo sapiens
guguguugucuuucauuuagucccuccaguuuggguuucucuuguaggacuagggacauggggagcugauaccauac

SEQ ID NO: 56281 - RNA, 56 nt, Homo sapiens
guguguuuguguguguauaugaguguguccauauacauaugcagacacauacauac

SEQ ID NO: 56282 - RNA, 112 nt, Homo sapiens
guguuaugcuggguaagguuuggcaaauagguuuuauugcauugccaauuuuguuugauuggagauuugcuuugagggcuguguugcagaugacucuguauccguguaauac

SEQ ID NO: 56283 - RNA, 56 nt, Homo sapiens
guguucaaagcugauugagauuagauggauuuguuuauuaaaguuagcuuuagcau

SEQ ID NO: 56284 - RNA, 61 nt, Homo sapiens
guguucaaauucugacagagagcuggucucaaauuccagcagucacugaccaguugaauac

SEQ ID NO: 56285 - RNA, 55 nt, Homo sapiens
gugggaagcuggaacucccuccaucucucugugguaaggagguuccccuacccau

SEQ ID NO: 56286 - RNA, 96 nt, Homo sapiens
gugggaggauugcuuaagcccaagagagcaaggcugcagugagccaugaucacaucacugcacuccaguuugggcagcagagcaagacccucucuc

SEQ ID NO: 56287 - RNA, 90 nt, Homo sapiens
gugggcacagauggaguggaggccaaguucuuuuggugagauaguuuccugcuaagauucaucaguugagcugguugcuucaguucccac

SEQ ID NO: 56288 - RNA, 90 nt, Homo sapiens
gugggcauuugagaacugguagcacuugugauuaugaguaauaauguucaccuccccugcuccucacugucugccaggucucugccucac

SEQ ID NO: 56289 - RNA, 66 nt, Homo sapiens
guggggauuaagugagaguuggguggggcuccuugcuccucuucccaguuaauccuuaaucuccac

SEQ ID NO: 56290 - RNA, 88 nt, Homo sapiens
guggggccuggaaguguggaagugucuggggccaggggccugaccacauggcaccuucuuuagagauuuuuaaccaauccauccuugc

SEQ ID NO: 56291 - RNA, 79 nt, Homo sapiens
guggcacaacaaugugcauguacuuagugcuauuugaaccauacacuucaaaugacuaagaugguacauuuuauguuac

SEQ ID NO: 56292 - RNA, 101 nt, Homo sapiens
guggcacauggaaugccagugagacagaaccauucacuccccuggaaaggcgucuaaagccagggagccaaguggucuagcucagcguaucccacccccac

SEQ ID NO: 56293 - RNA, 98 nt, Homo sapiens
guggcagcuuggagacuguaggugggaggaaaaggaauugccaguucaguaaacuuugucaaugcauuauucucccacuucagacuuccgagggccac

SEQ ID NO: 56294 - RNA, 60 nt, Homo sapiens
guggaagguaaguuuugagcauuauauacuucugaaaaugucuuuauuuuaccuuccuac

SEQ ID NO: 56295 - RNA, 68 nt, Homo sapiens
guggaaugauaucucauuguggcuuugccuugcauuucacuaauggcucaagaugaauaucuuuucac

SEQ ID NO: 56296 - RNA, 55 nt, Homo sapiens
guggaaugcaguguugauucaacacucaauguugaaaucaaucaguguaauuuac

SEQ ID NO: 56297 - RNA, 86 nt, Homo sapiens
guggaggaagaguacaauagugacaaaucagcaugcaaacauuuuucggcugauuuugcacucuuguccucucaguguuccucuau

SEQ ID NO: 56298 - RNA, 58 nt, Homo sapiens
guggaggagaugggaagcaaaaucaguuguaugaauccaguucccauguuucuucuac

SEQ ID NO: 56299 - RNA, 58 nt, Homo sapiens
guggagucauacagaacaagacuguuucuuccuaacagugcuucugauaugaugccau

SEQ ID NO: 56300 - RNA, 81 nt, Homo sapiens
guggcaguuucuuaguucauuuuucuugcuuagaacaccugaggcugggugauuuauaaggaaaauaaauuuauuuguuac

SEQ ID NO: 56301 - RNA, 123 nt, Homo sapiens
guggccaaacugggauucagacccagggcuguuugguaccacccuuuuuccagaagccgggcaagugucaggccggcuugcuggcaggggucggugggcucugggucccuucccugaagccac

SEQ ID NO: 56302 - RNA, 58 nt, Homo sapiens
guggcgagaucauagcucauuguagucuccaacuccugggcucaagugaucuuuccac

SEQ ID NO: 56303 - RNA, 57 nt, Homo sapiens
gucuggcuuauuucacuuagcauaauguccuuuuuauguugucacaaauggccggau

SEQ ID NO: 56304 - RNA, 103 nt, Homo sapiens
gucugguggggacuuggagaaccuuuaugucuagcucagggauuguaaacacaccaaucagcacccuguguuuagcugaagguuugugagugcaccaaucgac

SEQ ID NO: 56305 - RNA, 76 nt, Homo sapiens
gucugguguaugccugauucuguggcuaugaaacauccggaauagacaaauccauagagcuaggaugcagacagau

SEQ ID NO: 56306 - RNA, 72 nt, Homo sapiens
gucuuacuuagauuugcaacuuagaaaaaucauuuugauuacaauauggaaaauagguugcgagagugagac

SEQ ID NO: 56307 - RNA, 58 nt, Homo sapiens
gucugcuaucuguggagauucacucagcugguuggugacagucucccgauggcuaggc

SEQ ID NO: 56308 - RNA, 79 nt, Homo sapiens
gucuuuacacacaaaguagauuagucuuccacuugaaacugcccaauggaagaauuucuuuuucugauguuuugaagac

SEQ ID NO: 56309 - RNA, 101 nt, Homo sapiens
gucuauuaggaaaauaaaggaauaaagcauggcuacuccauaggcagagcagcuccaaggccugcugguuggcuauuuuuaugguuauuucuugauuagau

SEQ ID NO: 56310 - RNA, 57 nt, Homo sapiens
gucuauuuggggauaacuaggcuucccguaucuggauaucuaaaucucuugauagac

SEQ ID NO: 56311 - RNA, 65 nt, Homo sapiens
gucucacagcuagcugcuuuauuauauguagggaaaccuggcaaaccaagcaguaguuguggggc

SEQ ID NO: 56312 - RNA, 65 nt, Homo sapiens
gucucaccuccaaauaucaucacauuggugauuaggccuucaauauaugacauuuggggguggac

SEQ ID NO: 56313 - RNA, 71 nt, Homo sapiens
gucucacuauguuggccaggcuggucucgaacuccuggguuugagcaauccuccugccauguagcugggau

SEQ ID NO: 56314 - RNA, 60 nt, Homo sapiens
gucucacugucaacauguauuuggggagacaucaaacucaguaugaauugacaggaugau

SEQ ID NO: 56315 - RNA, 78 nt, Homo sapiens
gucucuaagcuguaagaucugcagcugucauuaaaauaucuacaguucuguagcuuuuauaugcuuagccaaacagac

SEQ ID NO: 56316 - RNA, 58 nt, Homo sapiens
gucucuaaguaaacuugaaaggcauuguaggccauaaggauuucaagucuuaggugac

SEQ ID NO: 56317 - RNA, 66 nt, Homo sapiens
gucucuagccaaagcacaauccauugaauauuauuuauuguuuauuagagauauuugguuagggac

SEQ ID NO: 56318 - RNA, 101 nt, Homo sapiens
gucucugaguaaacaaagugcaugacugauauuugagauacuucaugccuuaucucuggauaucuacuuauguucuauuuucauuuguuuguuuuugaagu

SEQ ID NO: 56319 - RNA, 85 nt, Homo sapiens
gucucuucccaggaggguaugcacacucucccaggaggguaugcacacucucccaggaggguaugcacacucccccuggagggau

SEQ ID NO: 56320 - RNA, 62 nt, Homo sapiens
gucugacacagugauuaguaaauuaauucaacaaauuauugagcaucuacuguguuccagac

SEQ ID NO: 56321 - RNA, 86 nt, Homo sapiens
gucugagggggaucuuguggugcuuuuacgugggccugccauggcugcccauguaacaaucagcaugcccuuccccgcucugaggc

SEQ ID NO: 56322 - RNA, 89 nt, Homo sapiens
gugaugauugugcuggaggaauaugcuuauuagcaagaaauacuaaaguauuugggcaugauggggcauuuucacaguuuaagcuuugc

SEQ ID NO: 56323 - RNA, 113 nt, Homo sapiens
gugauauauauuuuuuuauuuuugaaagaugaacuggauuggaagauuuaucuuuguugugucuauuuugcaauugaggaaucauuuauuuuuagagaggugaauaaauucac

SEQ ID NO: 56324 - RNA, 69 nt, Homo sapiens
gugacugcauccauccaggcuuuagcugcaagcuggauccuguuucucuuggaaagugcuagaagucac

SEQ ID NO: 56325 - RNA, 78 nt, Homo sapiens
gugagaaaugagacauuaaaguguguuuggagccuuuuauauauuucaacuuuaaaaacaauuuggugucuccaucau

SEQ ID NO: 56326 - RNA, 67 nt, Homo sapiens
gugagaacugugucuuauaaacguugcugucuuagaauuaaugacgaggccgggcacaguugcucac

SEQ ID NO: 56327 - RNA, 84 nt, Homo sapiens
gugagcagacuuccuuggagaugaagcagaguugcugugaucuaauucauugacucaguuguuagucuucauuuacuuucucac

SEQ ID NO: 56328 - RNA, 122 nt, Homo sapiens
gugaggcuggagggggagucugggggaggaggugaggcuagauggggauguguccagggcagguagccuugagaccccuuuauuuagccccagcucagggaacccucccacaguggccuugc

SEQ ID NO: 56329 - RNA, 91 nt, Homo sapiens
gucuuuguccuugguucuaugucaaggugaagaaagaucagcagaauguuggauuucuagcaccuuauuuuuaacuaagcaacgcagagau

SEQ ID NO: 56330 - RNA, 61 nt, Homo sapiens
gugaaagguaggaacagggugcaggucaccagacucugaggccaguguucuuccucuuugc

SEQ ID NO: 56331 - RNA, 56 nt, Homo sapiens
gugaacuaaggauucaaacuucagauuucaaaguccaaagugaaugcuuuguucac

SEQ ID NO: 56332 - RNA, 73 nt, Homo sapiens
gugaaguuuuugugaggccuaaagaauaaauuuaauuuucucuggguacauuugucucauguaauaacuuuau

SEQ ID NO: 56333 - RNA, 58 nt, Homo sapiens
gugaaguuuuuugcugagagucccucugcgugguggccucugugguauagaacuucau

SEQ ID NO: 56334 - RNA, 84 nt, Homo sapiens
gugaauauuggagaagugcuuuuggacuaacaguaguaccauaaauaacuguuacugaguuaaagacaucucuaugugauuuac

SEQ ID NO: 56335 - RNA, 70 nt, Homo sapiens
gugaauuagguaguuucauguuguugggccuggguuucugaacacaacaacauuaaaccacccgauucac

SEQ ID NO: 56336 - RNA, 68 nt, Homo sapiens
gugacaauagauauaaggaaccuuugcaaacuagaguguguuaugcaaauguuaggugucauuaucau

SEQ ID NO: 56337 - RNA, 60 nt, Homo sapiens
gugacagucaaagacaugacuugaugcggagaugugaagugugacuuuuuugacugucac

SEQ ID NO: 56338 - RNA, 64 nt, Homo sapiens
gugacauguaaggcucucucuguuaugucuagguggacacagcaaugcagugccuugcagucau

SEQ ID NO: 56339 - RNA, 58 nt, Homo sapiens
gugacauuauuucagcuacaugagugaccuuagacucauguggcugaaauaaugacau

SEQ ID NO: 56340 - RNA, 69 nt, Homo sapiens
gugacauuuaaagcuggcguuacaguuuguagguuuuacaaaucauggcucuagcuuacaaauguacac

SEQ ID NO: 56341 - RNA, 63 nt, Homo sapiens
gugcugcuggaacauauuauuuuuguucuuaaaauggacaagacuucuuguauucuaguucac

SEQ ID NO: 56342 - RNA, 62 nt, Homo sapiens
gugcuggcauuauagucaugagccacugcgcccggcccauaugucuauucuaaugccagcac

SEQ ID NO: 56343 - RNA, 79 nt, Homo sapiens
gugcggauggauugcuaauguggggauuuggggggaaaucaaaguguucucaaaugcuguauuguaguaauacuugcac

SEQ ID NO: 56344 - RNA, 60 nt, Homo sapiens
gugccucaggagacuauucagcaagcaacaauucugcuucagaguagcugucugaggugc

SEQ ID NO: 56345 - RNA, 80 nt, Homo sapiens
gugcguuauuagagcaaguuuucugacauauaaaccuggucccauauuauuuaucuguuuaaaacuguucagugauguac

SEQ ID NO: 56346 - RNA, 78 nt, Homo sapiens
gugauguugagauguauguauauaauguguagugaucagauaagguuaauuagcauacauagcaucucaaacauuuac

SEQ ID NO: 56347 - RNA, 85 nt, Homo sapiens
gugauuaugacauguauuuccaggauuuuagcauuucaaauagaaugugcauuuuuaaauacugaaauauacggucauccaucac

SEQ ID NO: 56348 - RNA, 97 nt, Homo sapiens
gugauucuccugccucagccucucaaguacaugggauuacaggugcgcgccaccaagcccaucuaauuuuuguauuuuaguagagacgggguuucac

SEQ ID NO: 56349 - RNA, 84 nt, Homo sapiens
gugcagcaagccuucgauuugcucacaguuguuuuaaacauuuuuaaaaguuuaaaugcacauacuugagaaaagcugcugcac

SEQ ID NO: 56350 - RNA, 72 nt, Homo sapiens
gugcauggaaggagaggaaugaaugacuguugaagccagauggccuugcucauugauucucuccuuucccgc

SEQ ID NO: 56351 - RNA, 94 nt, Homo sapiens
gugcauguacaugugugcaugcauguguguguguccaugugugugcauguguguguggacauguacauauguguaugugugccugugcaugugu

SEQ ID NO: 56352 - RNA, 79 nt, Homo sapiens
gugcauuuagaagcauugauccacaggcgugcuauuacucagcacuccuguggauacaaugauaaacuucacucagcac

SEQ ID NO: 56353 - RNA, 76 nt, Homo sapiens
gugccacacuaagaagaaauaaauauuguaauugaacuaugauucagugcuuuuuguugucaucauuguuuggcau

SEQ ID NO: 56354 - RNA, 63 nt, Homo sapiens
gugcaggugcaggagucagguccaggacccaugaggcccucagacacugcccuccaccugugc

SEQ ID NO: 56355 - RNA, 65 nt, Homo sapiens
ggggggcauuggcacagguguagaaaaugaagccugaggguccccugacuuguccgagguccccc

SEQ ID NO: 56356 - RNA, 77 nt, Homo sapiens
gggguagcccauguggcugaggcuucuagacacauuucaccucucaugggucagagacagacacaucgggcugcucu

SEQ ID NO: 56357 - RNA, 58 nt, Homo sapiens
gggguuccugugauuguuagaaagugacauucuuuacuuaucacaguucaggaacucu

SEQ ID NO: 56358 - RNA, 62 nt, Homo sapiens
gggguuuacacauugaugagcuuuaaggaauaaaagauaagguccuuaaauguguaaccucc

SEQ ID NO: 56359 - RNA, 129 nt, Homo sapiens
ggguaacacaugcuaaaauaagguguugcaccucagcagugguuggaggguaugaugagggcuucuacuuuauugcuauuauuugaccauuguacaaugagacuugauucauguuaaaguuaugaaccc

SEQ ID NO: 56360 - RNA, 80 nt, Homo sapiens
gggggcgagggauuggagagaaaggcaguuccugaugguccccuccccaggggcuggcuuuccucugguccuucccuccc

SEQ ID NO: 56361 - RNA, 78 nt, Homo sapiens
gggggaaaauacauauuuuguuuacauuaaauuuugaagugauuuaggcuuuauugaaaacaauacuggccuucccuc

SEQ ID NO: 56362 - RNA, 55 nt, Homo sapiens
gggggacuggccaugcucuaugaguuaguuuaauggaguguagaagccagccucc

SEQ ID NO: 56363 - RNA, 85 nt, Homo sapiens
gggggauaaagcaagucucuggccucaccccagagauucugacucagcagaugaggccuggaaauaugcauuuauaagguccccu

SEQ ID NO: 56364 - RNA, 73 nt, Homo sapiens
ggguaaugaguauguucuguauuuucacugugauauuaauuucacugguauauacauaugucaaaauuuaccc

SEQ ID NO: 56365 - RNA, 68 nt, Homo sapiens
ggguacaugugcacaacaugcagguuuguuacauauguauaccugugccauguuggugugcugcaccc

SEQ ID NO: 56366 - RNA, 68 nt, Homo sapiens
ggguacaugugcacaacaugcaguuuuguuacauauguauacaugggccauguuguugugcugcaccc

SEQ ID NO: 56367 - RNA, 68 nt, Homo sapiens
ggguacaugugcacaacaugcaguuuuguuacauauguauacauguaccauguuggugugcugcaccc

SEQ ID NO: 56368 - RNA, 68 nt, Homo sapiens
ggguacaugugcacaacgugcaggcuuguuacauacguauacacgcgccauguuagugugcugcaccc

SEQ ID NO: 56369 - RNA, 68 nt, Homo sapiens
ggguacaugugcacaacgugcagguuuguuacauauguauacauaugacauguuggugugcugcaccc

SEQ ID NO: 56370 - RNA, 68 nt, Homo sapiens
ggguacaugugcacaacgugcagguuuguuacauauguauacaugcgccauguuggugugcugcaccc

SEQ ID NO: 56371 - RNA, 68 nt, Homo sapiens
ggguacaugugcacaacguguagguuuguuacauauguauacaugcgccauguuggugugcugcaccc

SEQ ID NO: 56372 - RNA, 68 nt, Homo sapiens
ggguacaugugcacaaugugcagguuuguuacauauguauacaugcgccauguuggugugcugcaccc

SEQ ID NO: 56373 - RNA, 62 nt, Homo sapiens
ggguagcaaauggcugucaaguagccaagagggcugagaguugacaaggagccauugcaucu

SEQ ID NO: 56374 - RNA, 86 nt, Homo sapiens
gggguccucaaugauuuuuaguguaaauggguucugagaucaaauaguuucagaaccucugauuuauacuuuaccguggugauccc

SEQ ID NO: 56375 - RNA, 81 nt, Homo sapiens
ggguccugcuguugcucaggcuggagugcaguguugugaucauggcucacugcagccuugagcucucagaucaaggugccc

SEQ ID NO: 56376 - RNA, 95 nt, Homo sapiens
gggccuuucggguuugguucaguauugcaccuggaguccuacaggaaaugaaagaguaauggacccagauuugucugaauccagagucgaagccc

SEQ ID NO: 56377 - RNA, 58 nt, Homo sapiens
ggggaaauuaucccagaagauaacagaaggguguucuggaacuucaaauaauuucccc

SEQ ID NO: 56378 - RNA, 108 nt, Homo sapiens
gggcuaggcugagcagcagaggagagauuggcuguggagaguauagaugacacaugaggccaggugaucucugagaaaaguuucucccaucuguugcuuagauugccc

SEQ ID NO: 56379 - RNA, 81 nt, Homo sapiens
gggcugauuacaagguacacuuaaacugcuaaaaugauaguucauguuauucauagugcuaagguguaucugguaaugccc

SEQ ID NO: 56380 - RNA, 92 nt, Homo sapiens
ggggccuggggagcgugguggcacugagcaagcucacaaaggccucugugucgccuggcagcucaggccccgcgcugagggcccugggcuuu

SEQ ID NO: 56381 - RNA, 78 nt, Homo sapiens
ggggcgacgaugauaucacucccaauaucgcagggguugcacacaccacuugcgauguggggagugagagccagcccc

SEQ ID NO: 56382 - RNA, 88 nt, Homo sapiens
ggguuacuuugucuauuuuuaaaaucggguuauaaguuuucuuguuauugagcuguaugaguuguuuauaaauuuuggaaguuagccc

SEQ ID NO: 56383 - RNA, 66 nt, Homo sapiens
gggugcguucugagaaguguguuguuaggcaguuucguccuuaugugaacaucauagaaugcacuu

SEQ ID NO: 56384 - RNA, 56 nt, Homo sapiens
gggugucuucagcuacauuggguugcccuugacccucauugugauugaagucaucc

SEQ ID NO: 56385 - RNA, 62 nt, Homo sapiens
gggugugcaaaucucugaguaucuuuucaaauaaaggaaggaaauuaguuauuugccuaucu

SEQ ID NO: 56386 - RNA, 88 nt, Homo sapiens
ggguugguuccaagucuuugcuauuguaaauagugcugcaguaaauauacaugugcauaugucuuuauaguagaaugauuuauaaucc

SEQ ID NO: 56387 - RNA, 77 nt, Homo sapiens
ggguuguagugaggguuacgugaacauucauauaaaacaacuacaacaguguucaguaaauguucuuacuauagcuc

SEQ ID NO: 56388 - RNA, 58 nt, Homo sapiens
ggguuucuggucugugugauggagggcagcgugaacccaucacuggagaaggaaaccu

SEQ ID NO: 56389 - RNA, 83 nt, Homo sapiens
gguaacaucuuuauagcagugugaggacagacuaacacaucaucuguauuaguccguuuucacacugcugauaaagacauacc

SEQ ID NO: 56390 - RNA, 109 nt, Homo sapiens
gguaaggcugaaguaauagaaauaacuagaaaggagacaguugcuguuggaugcuucuuaaaagccuccuguugcacaccgucucucugguucuucugacuuucuugcu

SEQ ID NO: 56391 - RNA, 98 nt, Homo sapiens
gguaaguucgaucuuuucuuggugucuuccagucuuuucuguuaugcacuagaugugcuugacuaggaggcuggaggaugaggcuggagagcucuauc

SEQ ID NO: 56392 - RNA, 82 nt, Homo sapiens
gggucuaaugguauuucuaguucuagauccuugaggaaacacuacacugacuuccacaaugguugaacuaguuuacaguccc

SEQ ID NO: 56393 - RNA, 88 nt, Homo sapiens
gggucuugcucuguugccuaggcuggagugcaguggcgcaaucucagcucacugcaaccuccaccuccuggguucaagcgauucuccc

SEQ ID NO: 56394 - RNA, 93 nt, Homo sapiens
gggucuuuaugguaauggcaauaauagcuaccauuuauuaaguauuuauauuggggaugguuaaguauaugcauugucucuuuauaacuaccc

SEQ ID NO: 56395 - RNA, 76 nt, Homo sapiens
ggguggagguggagguauaagcccagaagaguauucuugaauuuuuuuggcuagaaauauaccuccaaauacaccu

SEQ ID NO: 56396 - RNA, 57 nt, Homo sapiens
ggguggaucacuugagaccaggaguuggagaccagcuugggaaacagagugaaaccc

SEQ ID NO: 56397 - RNA, 83 nt, Homo sapiens
ggguggcagcuggguucagagugggcugcggcccuccauaugugaguuucugggcuucaucccucaaacuccagcaaccauuc

SEQ ID NO: 56398 - RNA, 117 nt, Homo sapiens
ggguggugaccugggauucaaucugugaggaaggaaaccugcuagcaggacucucacuuugcugagcauuauuuuuccuucuuccuuuuugcccaauaaauuccauuuuccucaccc

SEQ ID NO: 56399 - RNA, 81 nt, Homo sapiens
gguaucuuuauagcaguaucccaccaucugguagcaauuuacuguauuaguccguucucaugcugcuaauaaagacauacc

SEQ ID NO: 56400 - RNA, 85 nt, Homo sapiens
ggucagagguuugcacauugcaccuuuuguaugguccaaguuaagaauauacacaaauucaugguuaauggugaauggcuuggcc

SEQ ID NO: 56401 - RNA, 59 nt, Homo sapiens
gguauuauagguugcuguggggcuugaauaaaauagccaucagagugagauauaagauc

SEQ ID NO: 56402 - RNA, 63 nt, Homo sapiens
ggucauaaagacacuuggcaugauuucagucuucucaaauuuguuaaggcuuguuuugagacc

SEQ ID NO: 56403 - RNA, 63 nt, Homo sapiens
gguccaugaauuccuuggcaaaacacccaaguugaaaaccucacuugacuguccagguggacc

SEQ ID NO: 56404 - RNA, 70 nt, Homo sapiens
gguauuucuaguucuagauccuugaggaaucaccacacugucuuccacaaugguugaacuaguuuauacu

SEQ ID NO: 56405 - RNA, 66 nt, Homo sapiens
gguauuucuaguucuagauccuugaggaauccacacugucuuccacaaugguugaacuaauuuacu

SEQ ID NO: 56406 - RNA, 70 nt, Homo sapiens
gguauuucuaguucuagauccuugaggaaucgccacaccgucuuccacaaugguugaacuaguuuauacu

SEQ ID NO: 56407 - RNA, 89 nt, Homo sapiens
gguauuuuauucucuuuguagcaauugugaaugggaguuuacucgugauuuggcucucuguuugucuguuacugguguauaguaaugcu

SEQ ID NO: 56408 - RNA, 74 nt, Homo sapiens
ggucaccaggugcuuuucagaagcuguugaccguaauucucuagcaguacauaaaaagcauccuggucuuggcc

SEQ ID NO: 56409 - RNA, 63 nt, Homo sapiens
gguagaggaugaggagguuggacguggugguggcuuugccuuggauauuccucuuccucuauc

SEQ ID NO: 56410 - RNA, 71 nt, Homo sapiens
gguagaggugggagucuugcuauguugcccaucucaaacuccugggcucaaguaauccucccgccuuggcc

SEQ ID NO: 56411 - RNA, 123 nt, Homo sapiens
ggcugaggcaggagaaucgcuugaacccuggaggcggagguugcagucagccgagaucguaccacugcacuccagggggcaacagugcaagacuccucaaaaaaaaaaaaaaaaaaauuagcc

SEQ ID NO: 56412 - RNA, 83 nt, Homo sapiens
ggcuccagagaucacaguuggcaaguggcugagcugggacgguauccagcucuaucugguuccaaagucuggucucuaaggcc

SEQ ID NO: 56413 - RNA, 59 nt, Homo sapiens
ggcuaacacagggcaagucaggcuccauuccuuugagagucaacugguucuguguaguc

SEQ ID NO: 56414 - RNA, 86 nt, Homo sapiens
ggcuaacacuaucugccuuacagggaugccaugagaauuaaauggaauaaugccucugaggaagauuguguuuucuaaaaauggcc

SEQ ID NO: 56415 - RNA, 90 nt, Homo sapiens
ggcugcacuugagugacauaaagugggggcuguguuggucauguacauagcauaucccacaugucagagauucccuuuuagugccuagcu

SEQ ID NO: 56416 - RNA, 59 nt, Homo sapiens
ggcugcuguuucucuuucagcaucgguaucugagaugcugucucugggaaacagcgauc

SEQ ID NO: 56417 - RNA, 60 nt, Homo sapiens
ggcuggaguguguugcagaugaaggaagauuucucaucaccccacacacucucugcagcc

SEQ ID NO: 56418 - RNA, 88 nt, Homo sapiens
ggcugggacugaggucauguucugucagguuccaaagagcgccaggaagacucugagaccacagagcacggccugcuuucucccagcc

SEQ ID NO: 56419 - RNA, 82 nt, Homo sapiens
ggcugggauaagugagugauucaguguuagcuuuagugucaauagaacuugcacugaaauauucaacuuuuuucccacagcc

SEQ ID NO: 56420 - RNA, 89 nt, Homo sapiens
ggcugggucaaacgguauuucuaguucuagauccuugaggaaucaccacacugucuuccacaaugguugaacuaguuuacagacccacc

SEQ ID NO: 56421 - RNA, 89 nt, Homo sapiens
ggcugggucaaaugguauuucuaguucuagauccuugaggaaucaccacacugucuuccacaaugguugaacuaguuuacagacccacc

SEQ ID NO: 56422 - RNA, 58 nt, Homo sapiens
ggcuggugacccugugguggugacacuagagcccacccauucacggggagcagcagcc

SEQ ID NO: 56423 - RNA, 112 nt, Homo sapiens
gggauugcuggguuggaugguaauucuguuuuuaguucuuugaggaauugccacauugcuuuccacaauggcugaacuaguuuacucucaccagcaguguauaagugauccc

SEQ ID NO: 56424 - RNA, 99 nt, Homo sapiens
gggcaagauaaagaaauaaaggguauucaaauaggaagucaaauuaucuguuugcagaugacaugauuguauauuuagaaaaccugaucuuaucagccc

SEQ ID NO: 56425 - RNA, 78 nt, Homo sapiens
gggcacugccaagaagugucuaagcaggaggugcugugguccagucugcacuucggagacauucucuuggcauagccu

SEQ ID NO: 56426 - RNA, 59 nt, Homo sapiens
gggagcuuggaggcccggcugguuuuucuaaggaguuggccggguggccauggcugccc

SEQ ID NO: 56427 - RNA, 57 nt, Homo sapiens
gggaggagagugaggaggauaauuuaaaacucauuaugcuuuggucauacuucuucc

SEQ ID NO: 56428 - RNA, 89 nt, Homo sapiens
gggaggaucgcuugagcccgggaugcggaaguugcagugagccaaaauagugccauugcagcccacccugggugauagaaugagagccu

SEQ ID NO: 56429 - RNA, 81 nt, Homo sapiens
gggaggcauuucuaucacccauugcacaaagagggaaacugaggccagagagggcacuugcuuccucugugcaauccuccc

SEQ ID NO: 56430 - RNA, 90 nt, Homo sapiens
gggaggcuggaucccugcagaaacggcuuugaggguaguucuuucagcaaguacaccaugucuguuucugguuuggcuuuucaguuuccu

SEQ ID NO: 56431 - RNA, 72 nt, Homo sapiens
gggauaggaacuuugaaagucauuucuucuaaguagcaaagcugcuuguugaauugcauuuuccauuaucuu

SEQ ID NO: 56432 - RNA, 72 nt, Homo sapiens
gggcaucuagguugauuccaugucuuuucuauuaugaauagugcagugaugaaccuaggaguggaugugucu

SEQ ID NO: 56433 - RNA, 97 nt, Homo sapiens
gggccauguuggcaauaguugaucugugugauuggaugcauuuucaaagaguuuguuaauggugccuuucugcauagacaguguuccacaaucgccu

SEQ ID NO: 56434 - RNA, 130 nt, Homo sapiens
gggcccggagggcagcucacugggguugaggcugugaggcacugcugcuuuccaggagaacgaacucagcacacagucuggggcagacaguccuucagcucuucucacuguguguuucucuucugggucc

SEQ ID NO: 56435 - RNA, 91 nt, Homo sapiens
ggcugugaaccaggucaucaggacgggucaucugcuuccccacgggugugguugggcugcagggaccuuguugcugagacuaggaacagcu

SEQ ID NO: 56436 - RNA, 60 nt, Homo sapiens
ggcuuagagcaaaccagucacaaauuaaagagaaacaaaugugaccucugucucugaguc

SEQ ID NO: 56437 - RNA, 105 nt, Homo sapiens
ggcuuagcuguuuuaagccacccucucuccauugcucuaaucagguugggauggguuuuuccugagacgaauggagugaacauggcgcuaggacagcugucgguc

SEQ ID NO: 56438 - RNA, 67 nt, Homo sapiens
ggcuuauuaagucacacuagacaacugagguugccuaagacgucauugucuuggacuugcaagggcc

SEQ ID NO: 56439 - RNA, 120 nt, Homo sapiens
ggcuucuaguugacagcuggaaauggaggcauuucuggcagagaaacaggucuaaggaggcagcgccagcuuccucagguccugucucuacaaggccccauugcuguaacuagccaagcc

SEQ ID NO: 56440 - RNA, 59 nt, Homo sapiens
ggcuucuguccagggucucgggaauuuggcuuccaugucagggacgcuugacacaagcc

SEQ ID NO: 56441 - RNA, 91 nt, Homo sapiens
ggcuugcccaggaauugcaacuguugagguauagaacaccuuucaaguuuauuuagaaacccaaagugcuuuauaccacaguggugaagcc

SEQ ID NO: 56442 - RNA, 92 nt, Homo sapiens
ggcuugcuuguauacauacaugucuucucuccccucagggacccuguguuccuugagagaaaaggccaugccuuauguagcucaggaaugcc

SEQ ID NO: 56443 - RNA, 70 nt, Homo sapiens
ggcugugugaugugucaucugagagaguggguaaccccuauucccagcacauggccauuuauuuagagcc

SEQ ID NO: 56444 - RNA, 64 nt, Homo sapiens
gggaaagaaagagaacauucguguucucaaagccaaagagaaucacuguuaacaauuucuuccu

SEQ ID NO: 56445 - RNA, 64 nt, Homo sapiens
gggaacuuaguaucuuacucuucucagcaagggaguuagcugagaaugacugggcaugcugccu

SEQ ID NO: 56446 - RNA, 90 nt, Homo sapiens
gggaacuuguuaaagauucagauucuuaggccucacccuagagcuaacaaaucagaguaucugggagacuacauuuuuaacaagcuuccc

SEQ ID NO: 56447 - RNA, 66 nt, Homo sapiens
gggaagugugcagaguucucuuagaacacccagucacaugguguagagacugcucuuacacuuccu

SEQ ID NO: 56448 - RNA, 98 nt, Homo sapiens
gggaauaaacauggagcucaucuagcauagagguuggcaaacuuucugucaagaaucagauaguacauauuuuuggcuuugugggcucuaugguuccc

SEQ ID NO: 56449 - RNA, 73 nt, Homo sapiens
gggaauuaaguuaggcuucagcagucugagccuuggugugggcggagacauacaugaucuuaauuuauaucuu

SEQ ID NO: 56450 - RNA, 73 nt, Homo sapiens
gggaauucuuaugcacuguuguugugaauguaaacuauuucagccacuguggaaagcaguguggagauuucuc

SEQ ID NO: 56451 - RNA, 109 nt, Homo sapiens
gggacagagagagaggaggagguuggcuugagaugaagcuagaagaaugggcaaacuucacuucucuuuguucauuuguaccccaaguuguauucaucccuuucugccc

SEQ ID NO: 56452 - RNA, 67 nt, Homo sapiens
gggacaucuuucuagucagggucaaaauacugagaaguuauuucccaguggcuagagcagauauccu

SEQ ID NO: 56453 - RNA, 98 nt, Homo sapiens
gggacugugcaggagaaguuuugaugcacuuguaggacauuaguguuccaugagaugcaucaaagcugccucugcuaaaacugaaaauggguggucuc

SEQ ID NO: 56454 - RNA, 109 nt, Homo sapiens
ggccugugguaggaagcuuuggagcaguuagggcaaugggaccauuuguucacacaaacaucccugaguaucuaauguguuucugaguuuccuagcagaaauccaggcc

SEQ ID NO: 56455 - RNA, 109 nt, Homo sapiens
ggccuccuccccacucaugccccgaaugacugucagggcagucauugcagugaagccaugcaggaaugcccgacggcucaugaagggggccacgaacaggacagaggcc

SEQ ID NO: 56456 - RNA, 82 nt, Homo sapiens
ggccggcgcuuaccucugcuacaggguauguuuccacugacagacgcgcuggcgagaugcucgugugcagagagcacuggcc

SEQ ID NO: 56457 - RNA, 60 nt, Homo sapiens
ggcgauaaccacguuuacccuucauuaaaguguuuaugagcaguaaauguaucuauugcc

SEQ ID NO: 56458 - RNA, 60 nt, Homo sapiens
ggcgcaguagcggggcccagagcauacaagggauugggcuuuggcuucucugcugcagcc

SEQ ID NO: 56459 - RNA, 94 nt, Homo sapiens
ggcgccugcaucugucugguuucuccugaggauuucaugcuaucucauaacaugcuggaaggucaaagggaaagcagacaaagccaaaggagcc

SEQ ID NO: 56460 - RNA, 69 nt, Homo sapiens
ggcggagcuugcagugagccgugcagugagccaugcagugagcugagaucacgccacugcacuccagcc

SEQ ID NO: 56461 - RNA, 86 nt, Homo sapiens
ggaguuucccucuuguugccuaggcuggauugcagugacaugaucucggcucacugcaacuccgccucccagguucaagcaauucc

SEQ ID NO: 56462 - RNA, 89 nt, Homo sapiens
ggaguuuugcucuuguugccuaggcuggagugcaguggcacaaucuuggcucacugcaaccuccaccucccggguucaagugauuaucc

SEQ ID NO: 56463 - RNA, 97 nt, Homo sapiens
ggaguuuugcucuuguugccuaggcuggaguucaguggcgcaaucuuggcucacugcaaccuucaccucccaggucuccagguucaagcgauucucc

SEQ ID NO: 56464 - RNA, 60 nt, Homo sapiens
ggauaaaagucaucacaacuggagugagaugguaucucauuguaguuuugacuuuuauuu

SEQ ID NO: 56465 - RNA, 76 nt, Homo sapiens
ggaguugauugagguaaagcgaggucuccuacaagaugaugcacauccuacucuuguaaccuaugcugaccauucc

SEQ ID NO: 56466 - RNA, 79 nt, Homo sapiens
ggagggugcuaacguggucaccugaauuaugcaugucuauuguguucaaauaucauaaaucggugcaugaauacccucc

SEQ ID NO: 56467 - RNA, 60 nt, Homo sapiens
ggaguaaaugugugcauuucaaacuuuauguacuacuuuguaacacacacuguuuacucc

SEQ ID NO: 56468 - RNA, 62 nt, Homo sapiens
ggaguauucccugguuaaggaaagguuuacuaaagagaacuuccugagagaggaguaacucu

SEQ ID NO: 56469 - RNA, 88 nt, Homo sapiens
ggagucucgcucuguugccuaggcuggagugcaguggcacgaauucggcucacugcaaccuccaccucccagguucaagcaauucucc

SEQ ID NO: 56470 - RNA, 88 nt, Homo sapiens
ggagucucgcuguguugccuaggcuggagugcaguggcaugaucucggcucacugcaaccucugccucccagguucaagcgauucucc

SEQ ID NO: 56471 - RNA, 88 nt, Homo sapiens
ggagucucucccuguugccuaggcuggagugcaguggcgcgaucucggcucacugcaaccuccaccucccggguucaagugauucucc

SEQ ID NO: 56472 - RNA, 86 nt, Homo sapiens
ggagucuugcucuguugccuaggcuggagugcaguggcaugaacucggcucacugcaaccuccaccucccagguucaagcgauucu

SEQ ID NO: 56473 - RNA, 80 nt, Homo sapiens
ggagugaauuauagcuaacaucugugaaaaguuauguaucugaaugcacauuuuccagcaugagcuuuaguaccaacucc

SEQ ID NO: 56474 - RNA, 81 nt, Homo sapiens
ggagcauaggaugcacuguguguauuagcucauuuguauuuuucccacuucaaugagcuggucuacguguguaugagcucu

SEQ ID NO: 56475 - RNA, 60 nt, Homo sapiens
ggagccagaaaugcugugguuggggcauuucaucaaccaaaucacaguuguucugccuuc

SEQ ID NO: 56476 - RNA, 71 nt, Homo sapiens
ggagcuugaaagugauguccaggcuuucaggcuaauugcuggaaagccccagucauuuucuaaaaaguuuc

SEQ ID NO: 56477 - RNA, 80 nt, Homo sapiens
ggaggaagggaggaaagauguaauauuaucuaaauaucguagcaacauuuggagauagauacauuuuucuccauuuuucu

SEQ ID NO: 56478 - RNA, 88 nt, Homo sapiens
ggaggauugcuugaccccaggaguuggagguugcagugaacuaugauaauaccauugcacucuagucugggugacagagcaagacucu

SEQ ID NO: 56479 - RNA, 61 nt, Homo sapiens
ggaggcaaagcacuuugcuuggaaauauuuuucacaugacauacaaggugcuucgaccucc

SEQ ID NO: 56480 - RNA, 63 nt, Homo sapiens
ggauacugugauuuuuuccuauuccauagauugagaaucuaggcuguagagaaguucaguacc

SEQ ID NO: 56481 - RNA, 67 nt, Homo sapiens
ggauauaaagaguuaguaaaauuuccucuauccauuugggguauaggaaacaaacucucuuaaaucu

SEQ ID NO: 56482 - RNA, 129 nt, Homo sapiens
ggauauauacccacaguaggauugcuggaucauaugauagcucaauuuuuaguuuuuuaaggaaacucuaaauuguucuucauagugauuguacuaauuuacauuccuaauaacuguguaugaaggucc

SEQ ID NO: 56483 - RNA, 84 nt, Homo sapiens
ggaucuugcugugucacccaggcuggagugcaguggcgcuaucaugguucacuguagccucagccucuugggcucaagcaaucc

SEQ ID NO: 56484 - RNA, 59 nt, Homo sapiens
ggaugacauuacagucacuugcuguuggcuuugcucacagucaagaugugugucuauuc

SEQ ID NO: 56485 - RNA, 72 nt, Homo sapiens
ggaugagaugaauaccgacgauguagaaaaacugggcuaaacaauuuauauaaguacugcuucaucucaucc

SEQ ID NO: 56486 - RNA, 86 nt, Homo sapiens
ggaucuuauuuuugccaucaauuuaucuauguaacaagugguuuauuuauucauuggaugucugaaaugauuuaagaaugagauuc

SEQ ID NO: 56487 - RNA, 89 nt, Homo sapiens
ggaugaucagaaaggagaucaguaguaagauggaggaacaccagggaaagaucaucuugccacuucauccccuuuccagcuccccaucc

SEQ ID NO: 56488 - RNA, 60 nt, Homo sapiens
ggauuuuaauguccaaaagaaaaggauuugauaaacccuaauauuuuggauuagaaaucc

SEQ ID NO: 56489 - RNA, 68 nt, Homo sapiens
ggauuuugagguuauuuguucaagaaguuagcuuccccuaacucuuacauagaccucauugaaaaucc

SEQ ID NO: 56490 - RNA, 129 nt, Homo sapiens
ggauuauuacaauucaaggugaaauguggguggggacacagcaaaacuauaucaaugauaaaauguaagugauauggcuuggcuaugucaccacccaaaucucuucuugaauuguagcuccuauaaucc

SEQ ID NO: 56491 - RNA, 59 nt, Homo sapiens
ggauuccauuagcugagauaucuugugauagggagagguaucacaguagaauaggaucu

SEQ ID NO: 56492 - RNA, 79 nt, Homo sapiens
ggauuggauuauuuggucaauaaguauuuauuuggcauuuacuuugugccaaauacuuucauguugucuuguuuaaucc

SEQ ID NO: 56493 - RNA, 66 nt, Homo sapiens
ggauuguauuaccgaaguggagucccaaauucacccauucucagacuucagugcagguaacaaucc

SEQ ID NO: 56494 - RNA, 62 nt, Homo sapiens
ggccccuggcagucugccucuucacuguagcuggcugcaaguguagagaagaguugcuggcc

SEQ ID NO: 56495 - RNA, 56 nt, Homo sapiens
ggcccucugccuuuucaugugggauggcugccuuccacuagugagggcaaagggcc

SEQ ID NO: 56496 - RNA, 102 nt, Homo sapiens
ggcccucuugaucugaggcggggagacacagggauggguaggaccauggggguugaaccuuccuugcacuccacuguucuccuggcuuccaaagaacuggcu

SEQ ID NO: 56497 - RNA, 93 nt, Homo sapiens
ggccaggcaugguggcucacgccuauaaucccaacacuuuaggaggcugagguaaguggauuaugaggucaggaguucgggaccagccuggcc

SEQ ID NO: 56498 - RNA, 94 nt, Homo sapiens
ggcaggagaauugcuugaacccaggggaggagguugcagugagcugagaucgcaccauugcacuccagccuuggggauacagcgagacucuguc

SEQ ID NO: 56499 - RNA, 76 nt, Homo sapiens
ggcaugaguucugggaagguugguucugccaaacauucauaugcguagagcacauuaucauuuccaaagcuuggcc

SEQ ID NO: 56500 - RNA, 123 nt, Homo sapiens
ggcaugcgccaccacgcccagcuaauuuuuuguacuuuuaguagagacgggauuucaccuguugaucaggcacccugucucuacuaaaaauacaaaaauuagcugggugugguggcgcaugcc

SEQ ID NO: 56501 - RNA, 111 nt, Homo sapiens
ggcaugguagcacaaaccuguaguuccagcugcucaggcaguuaaggcagaaaaaaugcuugagccuuggagugugagagcagccuggaaaacauagcaagaucccauguc

SEQ ID NO: 56502 - RNA, 71 nt, Homo sapiens
ggcagaugcugcaaucucggcacuuugggaggccaaggcaggcggcugggagguggagguuguagcgagcc

SEQ ID NO: 56503 - RNA, 69 nt, Homo sapiens
ggcaccuagaagaauuuuaguaucuuacuccccugcauuucagugagaugcuuguaaauucauuuugcc

SEQ ID NO: 56504 - RNA, 95 nt, Homo sapiens
ggcaaggggugacuccagucaagugcuuucuuggggauuuagugagguuagugacacuagccaagaauaauguacuugcuggagggaucagugcu

SEQ ID NO: 56505 - RNA, 127 nt, Homo sapiens
ggcacaaagcaaugaagacaugugagcaagcuucuuguucaugugcaugggaaucucaaguguuaccacuucauuuagaugauguuuacugagcaucaggagcaguauaugucagcaccaaugugcc

SEQ ID NO: 56506 - RNA, 90 nt, Homo sapiens
ggcacaacggaccacauauugcaugauuccauuuguguggaauggcuggaacaggcaaauccauagaugggaaacagauuagugguugcc

SEQ ID NO: 56507 - RNA, 61 nt, Homo sapiens
uugucugagauggagucuuguucugucacccaggcaguggcaagaucucagcucacugcaa

SEQ ID NO: 56508 - RNA, 96 nt, Homo sapiens
uuguaagugugcguucugggagcaucaagaccauccaagauucaggugaucccuggauggagaggcuugugaugccugggaaguguguguuaacag

SEQ ID NO: 56509 - RNA, 85 nt, Homo sapiens
uuguagccagggaccccugacucauuaggacucaagacaccuaccugguuucauagccuucuaaugaguugucgccggguugcaa

SEQ ID NO: 56510 - RNA, 84 nt, Homo sapiens
uuguagcuggugauugguuucauucaguggaagagcugcaaauaaacuaagcuaacuggguaacagccaaggccaugguuacag

SEQ ID NO: 56511 - RNA, 93 nt, Homo sapiens
uugucaucaucuagcagaacaauacaauucgguugccggggcuuuuccuuccuguccugaguugaauugugucucucccaaaagauaugauga

SEQ ID NO: 56512 - RNA, 97 nt, Homo sapiens
uugggaaagguccuugauuucugagaccaaaacuuguaacugagcuuuagauuauaaaugcucucaagaguguucaagugaguaaccccuuucucaa

SEQ ID NO: 56513 - RNA, 79 nt, Homo sapiens
uuggguugguggaaaauuauugcuguuuuugacauuacuuuuaauggcaaaaaccgcaauaacuuuuacaccaaccuaa

SEQ ID NO: 56514 - RNA, 94 nt, Homo sapiens
uugguaucagcaugauacuggcuucauagaaugauuuagggaggauucccucuuucucuauccuguggaauagugucaacaggauugauaccag

SEQ ID NO: 56515 - RNA, 60 nt, Homo sapiens
uuggucaggcuaaucucgaacguccaacgucaggaauguccggugauucgccugcaucag

SEQ ID NO: 56516 - RNA, 56 nt, Homo sapiens
uuggucaucucccuccuuuuagcuuaaaccgaagcaugaugggggagauaggccga

SEQ ID NO: 56517 - RNA, 60 nt, Homo sapiens
uugguccucccaugcucaagagacucucuuugccucagccuccugaguaacugggaccaa

SEQ ID NO: 56518 - RNA, 58 nt, Homo sapiens
uuuaacauuggaugagaucgucuaagugaacuaguccagugucccauccgauguugaa

SEQ ID NO: 56519 - RNA, 67 nt, Homo sapiens
uuuaaggcaugccuguacaugcucauacauuuuucuaaauauaaucuuaugugcaggaugcccugag

SEQ ID NO: 56520 - RNA, 80 nt, Homo sapiens
uuuaaugugaagugaagacucacagaaggccuggacagcugccugguccuuccugagucuuugaagcuuccaucauugaa

SEQ ID NO: 56521 - RNA, 72 nt, Homo sapiens
uuuaccaggcugggacaauuucuaaacacaguaaucauauuaaucauggcaagauuguuccgguuugguaga

SEQ ID NO: 56522 - RNA, 106 nt, Homo sapiens
uuuaccugauuacguugucugauguuaacagcacuacguggggauccaggauuucacuuggauaccaugcagcaugcuuuagagucagagagguggaacuggugaa

SEQ ID NO: 56523 - RNA, 86 nt, Homo sapiens
uuuagauaccucacguaaguggaauaauacaguauuuauucuucugugucuggcuuaucucacuuaccauguguccucuaucuagg

SEQ ID NO: 56524 - RNA, 113 nt, Homo sapiens
uuuagauggacuacagugaaaagaaaucacuagguaguaaucugcagagaaagccauucucuuuuauccuaucuuugcauuuccucuuaguuucugcacuaguuauaucuaga

SEQ ID NO: 56525 - RNA, 62 nt, Homo sapiens
uuuauagcagugaguauugacuaauacagaaaauugguaucagaaaugggcauugcuauaaa

SEQ ID NO: 56526 - RNA, 72 nt, Homo sapiens
uuuauauguaccuguuuaaaaaagugaguguacacucaaauuauuuaauuuuuggauaaugguacauguaag

SEQ ID NO: 56527 - RNA, 80 nt, Homo sapiens
uuuaucaagaaaagagguuuaauugauucacaguuccaaggagcuggggagacgucaguaaacuuaacaaucaugguaga

SEQ ID NO: 56528 - RNA, 81 nt, Homo sapiens
uuuaucaugugauaacauuucuucugguacacuugcacauaagaaagcuguauagaugaaaagauguugcaauuggaugaa

SEQ ID NO: 56529 - RNA, 87 nt, Homo sapiens
uuuaucugccugucauuuuguuuucauuauccaugauagcaaucucuugcauggcuuaugagaacauaucaagugauugguuuuaaa

SEQ ID NO: 56530 - RNA, 63 nt, Homo sapiens
uuuauuguguacuacaguaugccacacuguuaaauauugggcauguagaagugacaugaugaa

SEQ ID NO: 56531 - RNA, 76 nt, Homo sapiens
uugugaaagcucaggaaucaagauauucuuccuucgaaauacuuagauaugucuuaguuaccuugggcugccauaa

SEQ ID NO: 56532 - RNA, 62 nt, Homo sapiens
uugugaauggugccgcgauaaacauacgugugcauauguguuuauagcagcaugauuuauaa

SEQ ID NO: 56533 - RNA, 78 nt, Homo sapiens
uugugauuauuaagugcuugcagaaguccaugaccucgguguuauaggcuucuaaagugcaaguacuauacuucauaa

SEQ ID NO: 56534 - RNA, 60 nt, Homo sapiens
uugugcaugaugcauacauggucgcccaguuaaggugaccacaaucuuauauuaucacaa

SEQ ID NO: 56535 - RNA, 71 nt, Homo sapiens
uugugucuuacugaguugauugucuuagaaacauauaaacaugacuaugagaccagcuucagaaagcacga

SEQ ID NO: 56536 - RNA, 78 nt, Homo sapiens
uuguguuaagcuauauugaggaugccauucaauaauuacuuuaaaaugcauggcgacuucaaauaugaaggaacacaa

SEQ ID NO: 56537 - RNA, 74 nt, Homo sapiens
uuguguuuaaggaguagaauagaugcaccuucauucagaaaguggaaguuuaugaagucuaagccaaaacacaa

SEQ ID NO: 56538 - RNA, 77 nt, Homo sapiens
uuguuaaaaucauauucuuguucuguuccaaaucuugaauaacugaggcuuggaauaucaugagaguuuguuaacaa

SEQ ID NO: 56539 - RNA, 65 nt, Homo sapiens
uuucacuagggagaaacugaggcuuaggggccaccaugaucgagucucagccuuccuggcagaaa

SEQ ID NO: 56540 - RNA, 124 nt, Homo sapiens
uuguuuauaaauuacccaggcucagguaucuucauuauagcagugugaaaauggacuaauauagagaauugguacugguagagagaggcauugcuauaaggauaaccugaaaauguggaagcaa

SEQ ID NO: 56541 - RNA, 58 nt, Homo sapiens
uuuaaagcuccaagcaugucuggcauauaguaugcaaccaguaagugcuaguuuuaaa

SEQ ID NO: 56542 - RNA, 91 nt, Homo sapiens
uuguggauauugaaguuugaagccuguuguucaucuauagaugcacuggaugggauuggaagucuucagauuucaguaggguuuuccacaa

SEQ ID NO: 56543 - RNA, 73 nt, Homo sapiens
uuguuccacaaauauuucuugagcaccugguauuugcccagcacugugcuaggugcuaggaagauaggaauaa

SEQ ID NO: 56544 - RNA, 74 nt, Homo sapiens
uuguuccuucaguuauccagugaaagacaaauggauucagggaucccuguaaaucugguuaauuggauaaauaa

SEQ ID NO: 56545 - RNA, 58 nt, Homo sapiens
uuugcuauagugaauagugcugcagugaacauaugcgugcaugggucuuugugguaga

SEQ ID NO: 56546 - RNA, 58 nt, Homo sapiens
uuugcuauugugaauagugccgcaauaaacuuacgugugcauaugucuuuauagcaga

SEQ ID NO: 56547 - RNA, 69 nt, Homo sapiens
uuugcuguuugguuggcuuagccauuccagccuuugggcuuuggaaaguccaagccaaccgggggcaga

SEQ ID NO: 56548 - RNA, 98 nt, Homo sapiens
uuuggauuggcauuucucugaugaucaaugaaguugagcaccuuuucauaugccugucugccauuuguaugucuucuuuagagaaaugucuauucaaa

SEQ ID NO: 56549 - RNA, 57 nt, Homo sapiens
uuuggcuuugagaagcaguggagcuggggcaucagaauccagugaggcaaaguggga

SEQ ID NO: 56550 - RNA, 129 nt, Homo sapiens
uuuggggauguguacuuuuuuguccuccauccuucuucacaugugcguuuuggcauguguuauaacuuggcacuaaaaugcacaugugaagaaggaaggaggacagaaaaaagaguacccauccccaaa

SEQ ID NO: 56551 - RNA, 89 nt, Homo sapiens
uuuggggcuaaaaacuuccuuguuuuguuauuguaucauauuggagcucacauauuuugaugagaggugauaaagcaaggguccccaga

SEQ ID NO: 56552 - RNA, 65 nt, Homo sapiens
uuugguaguuuguugggacccaugggugggcaugggaagcugacauuuccaaaggaacuaccaag

SEQ ID NO: 56553 - RNA, 57 nt, Homo sapiens
uuuguaacaugcuuucacuucaguuaaagcagaaacugaugugauauaugugacaga

SEQ ID NO: 56554 - RNA, 59 nt, Homo sapiens
uuucauaguaacaguaacuaugguagguaacuuauuuauaguguuccuuuacuaugaaa

SEQ ID NO: 56555 - RNA, 57 nt, Homo sapiens
uuucauaguuugcauagggcauuugcauagggcaaaugcuuuaguacagacuuggaa

SEQ ID NO: 56556 - RNA, 59 nt, Homo sapiens
uuuccacuuuguuauggggauauauguauuauuauuuaucucaaugcacagagaggaaa

SEQ ID NO: 56557 - RNA, 70 nt, Homo sapiens
uuucccagaagcagagccugaggcagggauucagaugcucaugaacuguuugaggguuugcuuucagaag

SEQ ID NO: 56558 - RNA, 55 nt, Homo sapiens
uuucccugaaggcucugaagucccauacgggaaaccaugagggccuuccgggaag

SEQ ID NO: 56559 - RNA, 129 nt, Homo sapiens
uuucccuugggauauuauaacauaaccugcuuguaaauuugagauuaaucuuuaaguaagaucugucuguaaaucaaaccacaccaguguuacuaagaugaguuucuugcagguuuguccuaggagaga

SEQ ID NO: 56560 - RNA, 64 nt, Homo sapiens
uuucccuuucugccuugaaucuuucaugccuccaggucaaaagagagagacagagacagggaaa

SEQ ID NO: 56561 - RNA, 64 nt, Homo sapiens
uuucuacagggcuugccagguaacacuuuccucucacguucuacucaagggcucucuguggaaa

SEQ ID NO: 56562 - RNA, 72 nt, Homo sapiens
uuucucuucucuagugauuagcaccucauguguaaaacgcaaugaguaugagaauacauuaagagaaagaaa

SEQ ID NO: 56563 - RNA, 58 nt, Homo sapiens
uuucugugaggauuuuaacaugagagucugcucaucacacgugaacucaucacagaga

SEQ ID NO: 56564 - RNA, 71 nt, Homo sapiens
uuucuuaaaagucauugaaaaauguauagcuagaguuaugucucuaugugcaaauuaauugcuagaagaaa

SEQ ID NO: 56565 - RNA, 65 nt, Homo sapiens
uuucuuuguuguuguagcuggagacaauuagguaacacaaauugucacccuacauaacagggaaa

SEQ ID NO: 56566 - RNA, 84 nt, Homo sapiens
uuugagaccagguuaugaaacuggcuaauuuuuguauuuuuguuaaauaccgaaauucacuguguugccaaggcuggucucgaa

SEQ ID NO: 56567 - RNA, 65 nt, Homo sapiens
uuugagaugcauacucaaauuaaguauauuuauuugaaaugcauauguugagaugcauauucaaa

SEQ ID NO: 56568 - RNA, 57 nt, Homo sapiens
uuugauguugagacuauaaagcuacaguaaucagcacagugugguauuggcaucaaa

SEQ ID NO: 56569 - RNA, 80 nt, Homo sapiens
uuugauuucuucuaauacacgguaugacuuugcucguuuuucauacaaguagacacugaaauguauugaagaguauuaaa

SEQ ID NO: 56570 - RNA, 56 nt, Homo sapiens
uuugcacauugauuuuguaucuugagacuuugcugaaguugcuuaucagugucaga

SEQ ID NO: 56571 - RNA, 57 nt, Homo sapiens
uuugcagagucuuucgcugggcugucuccccaucagcaagagaaagagcucuccaaa

SEQ ID NO: 56572 - RNA, 66 nt, Homo sapiens
uugccauguguguaaggugcugugaacugugagugcugaagauucgcagcauucaauaccaggcag

SEQ ID NO: 56573 - RNA, 67 nt, Homo sapiens
uugccauuccucguguucaggacaaaaugacauuccaggaauggaaucugaaccaugggaauggugg

SEQ ID NO: 56574 - RNA, 64 nt, Homo sapiens
uugcccuauauccagauucugucuacuaaauccacccccacuggccuguuuggguacuggguaa

SEQ ID NO: 56575 - RNA, 58 nt, Homo sapiens
uugcaaugugaugugauuuggauuuguguccccacccaaaucucacaucccauuguaa

SEQ ID NO: 56576 - RNA, 87 nt, Homo sapiens
uugcacaauuccaggaggcagcauucgcauagacagccuaccugugaucagccugggaugugacuguugcccccaugaguuaugcaa

SEQ ID NO: 56577 - RNA, 86 nt, Homo sapiens
uugcaggugggaagcaguuucucauaugaagugacccaguaagaaugugccucugccuucaaagugagcuccuucucacucugcaa

SEQ ID NO: 56578 - RNA, 84 nt, Homo sapiens
uugcauagauaucuggauaggaguaaaacauggacuuagaagaauguggcuucaaagucuauucuacccuuaccagcuguguga

SEQ ID NO: 56579 - RNA, 91 nt, Homo sapiens
uucuucccacagacauugauugaacaucuguucuuguaucccuccaugaagcuuggcacaaagcagguguccacaauguuugcugaaugaa

SEQ ID NO: 56580 - RNA, 130 nt, Homo sapiens
uucuuccuuuccaguugguaugccuuuuauuucuucuucuugccuuauugaagugacuaagacucccaauacuguguugaauaagaguaguaagggcagauauucuugcuuuguucugaccccuggaaga

SEQ ID NO: 56581 - RNA, 76 nt, Homo sapiens
uugagguaauaaacagccauuccuguuggauaaccccagagagugagacuuggcugcauaucccuaccugccucaa

SEQ ID NO: 56582 - RNA, 103 nt, Homo sapiens
uugagguggagucucacucugucacccaggcuggagugcaauggcguggucucggcucauugcaaucucugccucccagguucaagugauucuucggccucag

SEQ ID NO: 56583 - RNA, 58 nt, Homo sapiens
uugaguuugaguauucuaaagcugguucauaaaguugcuuuaguguaaucuuauucaa

SEQ ID NO: 56584 - RNA, 56 nt, Homo sapiens
uugauagaucagggauuugauuuuuuaaaagagagaaucuaacaccuuucuaucag

SEQ ID NO: 56585 - RNA, 61 nt, Homo sapiens
uugauauguuguuagauucaguuagcuaguauuuuguuaaggauucuagcaucuaugucaa

SEQ ID NO: 56586 - RNA, 101 nt, Homo sapiens
uugaucauuuagucagugagaaugcaugaaagacuuacauauuuuggugacuuauuucauuucuauuuguaagucuuugugcuucuaucuauaauaaucag

SEQ ID NO: 56587 - RNA, 73 nt, Homo sapiens
uugacuucagagcugauucaagccuuggaguaauuucaucccuccuuacucacuugaaucuaguggaagucaa

SEQ ID NO: 56588 - RNA, 103 nt, Homo sapiens
uugagacagagucuagcugugucacccaggcuggagugcaguggcgcaaucuuggcucacugcgacguccgccucccggguucaagcaauucuccuguuucag

SEQ ID NO: 56589 - RNA, 103 nt, Homo sapiens
uugagacggagucucgcucuguugccuaggcuggagugcaguggcacgaucucggcucacugcaaccucugccucccagguucaagagauucuccugccucag

SEQ ID NO: 56590 - RNA, 60 nt, Homo sapiens
uugagacggagucuugcucuguugcgcaggcuggagugcaauggcgugaucuccgcucaa

SEQ ID NO: 56591 - RNA, 55 nt, Homo sapiens
uugagacggagucuugcucuuuugcccaggcuggagugcaauggcucagucucag

SEQ ID NO: 56592 - RNA, 56 nt, Homo sapiens
uugagacggaguuuugcucuuguugcccaggcuggagugcaauggcuccaucucag

SEQ ID NO: 56593 - RNA, 56 nt, Homo sapiens
uugagacugaguuucacucuuguugcccaggcuggaguguaaugacucgaucucgg

SEQ ID NO: 56594 - RNA, 55 nt, Homo sapiens
uugagaucaugcuacugcacuccagcuugggugacagaguaagaccuggucucaa

SEQ ID NO: 56595 - RNA, 55 nt, Homo sapiens
uugagauggaaucuugcucugucuccuaggcuagagugcaauggugccaucucgg

SEQ ID NO: 56596 - RNA, 56 nt, Homo sapiens
uugagauggaguuucaauauugucacucaggcuggagugcaauggcucuaucucgg

SEQ ID NO: 56597 - RNA, 56 nt, Homo sapiens
uugagauuggagucucgcucugucguccaagcuggaguguauuggcacgaucucag

SEQ ID NO: 56598 - RNA, 70 nt, Homo sapiens
uugagauugggacagacagggagagugagauugggaaggagccacguucgguccccuuggcugcccucgg

SEQ ID NO: 56599 - RNA, 100 nt, Homo sapiens
uugagcagcaccgugccugcuagcccaagugcucuaggauccugagucaucucacgaugacacaggaagucagcacugauggcuggaggcgugcuuucga

SEQ ID NO: 56600 - RNA, 104 nt, Homo sapiens
uugagccaggagucuuguucugucauccaggcuagagugcaguggugugaucucagcucacugcgaccucugccucccggguucaagcgauucuccugccucag

SEQ ID NO: 56601 - RNA, 67 nt, Homo sapiens
uugagccuaugugugucuuugcauugugagaugggucuccucaauacagcacacagaugggucuuga

SEQ ID NO: 56602 - RNA, 104 nt, Homo sapiens
uugaggcaggagaaucgcuugaacccgggaggcggagguugcagugagccgagaucgugccauugcacuccagccuagccaacaagagcgaaacuccgucucaa

SEQ ID NO: 56603 - RNA, 121 nt, Homo sapiens
uuggcuuccuuuugcuuguguuacaagaggaccuuugggggcauauuagcuugcuuguuaagaccaaugaguaaaucacuaauggcuuccggccacuuugcauacauccaagaauaguuga

SEQ ID NO: 56604 - RNA, 55 nt, Homo sapiens
uuggcuuggagaguugaaauguuaauuugaugugcacaucuauucuuaaagccaa

SEQ ID NO: 56605 - RNA, 71 nt, Homo sapiens
uuggacccucaguggauuagauaaugcacccccaccuugaggagggcaaucuacuucacugacucuaccaa

SEQ ID NO: 56606 - RNA, 56 nt, Homo sapiens
uuggagagagaggacucccggcccuacccaggccucgugggaguuucugucuccaa

SEQ ID NO: 56607 - RNA, 64 nt, Homo sapiens
uuggcagaugagccgcgcuccaagaaccagcuguugaacguuugugagugcaggcuggugccag

SEQ ID NO: 56608 - RNA, 56 nt, Homo sapiens
uuggccagugucuuuuuuuccugucauauauuuaggaagauugagauaaugacuaa

SEQ ID NO: 56609 - RNA, 60 nt, Homo sapiens
uugcugagucuuucuagguugcuguugauguaagcaguggccaggcugagagcuuagcag

SEQ ID NO: 56610 - RNA, 82 nt, Homo sapiens
uugcugcacugagaugagagaaugcuugccugagauguguaguucugucggggguaucuuuuucucuucaucagccaaguaa

SEQ ID NO: 56611 - RNA, 73 nt, Homo sapiens
uuggaauuaaaauggguaauuggcaaauagaaaguauugaaaccaauuuucacagcaauugccuauuguccaa

SEQ ID NO: 56612 - RNA, 68 nt, Homo sapiens
uuggauaucauuggccauguuucaaucgaauggagccacugggccccaacacuggcuuugagauuuag

SEQ ID NO: 56613 - RNA, 103 nt, Homo sapiens
uuggcaaaugaaugagucauccugagccucuguccucacaucuguaagagggagcccuaauaguagguguugguagagguuucguggcaaccucgugagcuga

SEQ ID NO: 56614 - RNA, 87 nt, Homo sapiens
uuggcaagaucaauguaaguggauuucaaauuccauaaggaacugauuugguggagaacauucauuugcaagaguagauuuagcuaa

SEQ ID NO: 56615 - RNA, 60 nt, Homo sapiens
uuggcaaguccccaccucucucuuucaguccauguguugggggaggucagggcuggccaa

SEQ ID NO: 56616 - RNA, 63 nt, Homo sapiens
uugauucguguauauucaaccuugcauccuagggaugaagcuaacuugauugugauggaucaa

SEQ ID NO: 56617 - RNA, 116 nt, Homo sapiens
uugccuccagauggcuuuaggggccaugcagagggcagugguagguaugagggagccagcggaggcuucuuuggaggcgaucuguuugaugugauacggucuguggauggaggcag

SEQ ID NO: 56618 - RNA, 82 nt, Homo sapiens
uugccuucagggaauguuauuuaauagcauauuugugaucuucuagccuguugugccaaaaaauagcauucccucaaagcag

SEQ ID NO: 56619 - RNA, 92 nt, Homo sapiens
uugccuuucuaauuaugacaauuguuuucuuguguagguauuaucaaaaccaguaccacugccgagaaaacagaugaagaggagaaagguaa

SEQ ID NO: 56620 - RNA, 69 nt, Homo sapiens
uugcuaaugaaguuucaggcaccauugucauugauaacaucuuaucaggagacaggguuuugagagcaa

SEQ ID NO: 56621 - RNA, 73 nt, Homo sapiens
uugcuauguaauuguguauauuucaguuuguauacuucauaucuccaugaaauugcacauuccuugcuggcag

SEQ ID NO: 56622 - RNA, 77 nt, Homo sapiens
uugcucuguugccuaggcuggagugcaguggcaugaucucagcucacugcaaccuccaccucccagguucuaaguaa

SEQ ID NO: 56623 - RNA, 77 nt, Homo sapiens
uugcuugaacccaggaggcagagguugcagugagccgagaucacgcuguugcacuccagccugggugacaagagcaa

SEQ ID NO: 56624 - RNA, 76 nt, Homo sapiens
uugcuugaacccaggaggcggagguugcagugagccaagaucgugccacugcacuccacccuuggcagcagagcga

SEQ ID NO: 56625 - RNA, 70 nt, Homo sapiens
uugcuugaacccaggagguugcagugagccgagaucguguuauugcacuccagccuggguaacagagcaa

SEQ ID NO: 56626 - RNA, 68 nt, Homo sapiens
uugcuugaagcugcgaggcggaggcugcagugagacgagauugcgccauugcacuccagccuggguaa

SEQ ID NO: 56627 - RNA, 76 nt, Homo sapiens
uugcuugaauccgggaggcagagguugcagugagcugagauugcgccacugcacucuagccuuggcaacagagcaa

SEQ ID NO: 56628 - RNA, 68 nt, Homo sapiens
uugcuugagccggggaggcagagguugcagugaccagagauugugccacugcacucuggccugggcaa

SEQ ID NO: 56629 - RNA, 68 nt, Homo sapiens
uugcuugagccuggaaggcagagguugcagugaaccgagauugcgccauugcauuccagccugggcaa

SEQ ID NO: 56630 - RNA, 64 nt, Homo sapiens
uugcuuuguuacugcaguuuccacucuuucagcuccagcugggcugacugcagcugcagggcag

SEQ ID NO: 56631 - RNA, 94 nt, Homo sapiens
uugcuuuuaagaaaaugcuuucuuggaccauuuggauuacagccuuuccacuaggcugcaaauauucauaaagguauucauuccuaaaagacaa

SEQ ID NO: 56632 - RNA, 64 nt, Homo sapiens
uugcuuuuugcuauuuugagucuauucugcagcauagagguauaccaaaaaggcaucugagcag

SEQ ID NO: 56633 - RNA, 58 nt, Homo sapiens
uuugcgcuuuuccuauguugcccuggagagcagaucuagggagcguggaaggugcaga

SEQ ID NO: 56634 - RNA, 120 nt, Homo sapiens
uuuuuuuuuuuugagauggagucuuacuuugucacccaggcuggagugcagugagccaagauugcaccauugcacuccagccuggcaacaagagcgaaacuccaucucgggaaaaaaaaa

SEQ ID NO: 56635 - RNA, 63 nt, Homo sapiens
uuuuuuaguuagcugggcaugauggcucauacccacagccugcagucccagcuacuuaggagg

SEQ ID NO: 56636 - RNA, 93 nt, Homo sapiens
uuuuuucaauuuuauuuuagauuugggguacaugcacagguuugcuaccuggcauauugcaugaugcugagauuugggauaugaaugaaagga

SEQ ID NO: 56637 - RNA, 95 nt, Homo sapiens
uuuuuucucccauucaugcugucagaaauuuauuaaaaagcaaaugaagugugauaauaguuuuuaagugaauuugacagguaaugaagaaaaaa

SEQ ID NO: 56638 - RNA, 65 nt, Homo sapiens
uuuuuuguagagacaggaucucacuauguugcccaggcugguuuugaaccccugcucucaagaaa

SEQ ID NO: 56639 - RNA, 69 nt, Homo sapiens
uuuuuuucugguuguguaauuuuaaauagaaccccagggguuugcuuugagaaugcuaccagagaagag

SEQ ID NO: 56640 - RNA, 67 nt, Homo sapiens
uuuucuccuguuaaucugucuuuuguuauugaggguuuagccauaaaccuagcaauggaugaggaaa

SEQ ID NO: 56641 - RNA, 78 nt, Homo sapiens
uuuucuugggugaguuugugaauaaauuaaguugcuuuuuaaucuguugcuuuuaauugcaaauacaucccaggagaa

SEQ ID NO: 56642 - RNA, 58 nt, Homo sapiens
uuuugaaagacaucaccuacugcucaauaccugguugaggcagauugucucuucagaa

SEQ ID NO: 56643 - RNA, 82 nt, Homo sapiens
uuuugaaauguuuuguucuugaguugggaguacaaaguguccagcacuugguauucuuauccaggaaugagcauuuacaaaa

SEQ ID NO: 56644 - RNA, 57 nt, Homo sapiens
uuuugaggaacuuuauucuuaucuauauccaggauacacugugagguauccucaaaa

SEQ ID NO: 56645 - RNA, 77 nt, Homo sapiens
uuuuguuuuauagguccugugagauguaugcauuaaagagguucuguuuugauguguuuccaggauuuguuucaaga

SEQ ID NO: 56646 - RNA, 60 nt, Homo sapiens
uuuuucaccugugaacugggacaucaguaaugaugggcucacuagaucaagggagagaaa

SEQ ID NO: 56647 - RNA, 79 nt, Homo sapiens
uuuuuccauagauagauagguagcaucauugauuugaaauaaauuaaauugcauugagcugcuuauuaauccagagaaa

SEQ ID NO: 56648 - RNA, 59 nt, Homo sapiens
uuuuugaggggauccaaguguucuaaaauugauuguagugacauagagacucucaaaaa

SEQ ID NO: 56649 - RNA, 107 nt, Homo sapiens
uuuuugauuguccauacuuaggcugccgcuaugcauguauaguggguagaagccagggaugcuucuaaacaucuuacaaugcauaggguagucuccugcaacaaaga

SEQ ID NO: 56650 - RNA, 77 nt, Homo sapiens
uuuuggaaagagguguuuaugacuuuuaguuggagugauguagaaacuguacaguuguaaacauauuuuuuucaaaa

SEQ ID NO: 56651 - RNA, 78 nt, Homo sapiens
uuuuggcuauuguuaacagugcuguuauaaauguacaugugcauguauuuguuugaguacuuguuuucauuucuagaa

SEQ ID NO: 56652 - RNA, 91 nt, Homo sapiens
uuuuggguaucuucuuagcagcaccccacucuacugguaccaauuuacuguauuagucuguuuucaugugcugaugaagauauacccgaga

SEQ ID NO: 56653 - RNA, 83 nt, Homo sapiens
uuuugguaaugauacauaagacauuuaaaaauugauaauauauaguguuggcaauugcuaugauuugaaugugucucccaaaa

SEQ ID NO: 56654 - RNA, 129 nt, Homo sapiens
uuuugguuaaauauugauaacuuugcacagcagaaugcagaauguucauuuuguggguagauagcagacaacuaacagguagagugaagcuuuuuauauucugugaaagugcagaagucauauaucaua

SEQ ID NO: 56655 - RNA, 77 nt, Homo sapiens
uuuuguauaguaguacaaaaguuuuucuacagcccuuuuaauggcugcaugaaaugccuuugugugacuguacuaaa

SEQ ID NO: 56656 - RNA, 110 nt, Homo sapiens
uuuuguauauggugguguuuggaagaagguauuuguaauauaugucauugaugugaaaauggcagauaggauacaggacuaacuugcagcucccacuuggauggacagaa

SEQ ID NO: 56657 - RNA, 61 nt, Homo sapiens
uuuguccucagcaccugggaagcaucaggaauacaccagcuucucagaggcaggggauaaa

SEQ ID NO: 56658 - RNA, 109 nt, Homo sapiens
uuuguuuugcacugcuucacucuacaaccuguuggggugaaucauacuuuguuauuaauugcucugaggcacucccuagcgggguggagcauuuggaguccugaauaaa

SEQ ID NO: 56659 - RNA, 74 nt, Homo sapiens
uuuuaaguuaagaaguguaacuuaaguuuaacuuuuuuuuaaguguaacuuaaguguaacuuuuuaaguuaaga

SEQ ID NO: 56660 - RNA, 83 nt, Homo sapiens
uuuuagacaagaaauuucaauauuauuuucagguccugguauacguggugaugaaaguuauauugugaaauucaauucuggaa

SEQ ID NO: 56661 - RNA, 59 nt, Homo sapiens
uuuuaguuacugcaguagcaaagagauucaugaguuuagccuauugcacauagcugaag

SEQ ID NO: 56662 - RNA, 72 nt, Homo sapiens
uuuuauaagauuacuauaaugugcagcuuauaacugcaaaaugugagaucugucuuuauaguauuuaugaag

SEQ ID NO: 56663 - RNA, 67 nt, Homo sapiens
uuuucagcagugugaaaacaaacuaauacaguaaauugguacuaguagagugggacguugcugaaaa

SEQ ID NO: 56664 - RNA, 85 nt, Homo sapiens
uuuuccaagaauuagccagaaauuccaugucacccauucuggucaguaggauggaagaaacgauuuucuggaaguuucuggaaaa

SEQ ID NO: 56665 - RNA, 89 nt, Homo sapiens
uuuuccacagcagcuugucaagagcuuuaucuuuucucccaucuguuuggauuggauacuuaacagcucuacagcugcucuuuggagga

SEQ ID NO: 56666 - RNA, 59 nt, Homo sapiens
uuuuccagugggacucccauuaucacuauguugauauucuugauggugucccaugaaaa

SEQ ID NO: 56667 - RNA, 58 nt, Homo sapiens
uuuuccauuuacuugugcugucucuguacacagcuaggcauuguacaguaauggaaaa

SEQ ID NO: 56668 - RNA, 78 nt, Homo sapiens
aaaaaaaauuuagauauauauauaaugggggaaucauaaacguguggaagucuucauuauguauaguaaguuauuuuu

SEQ ID NO: 56669 - RNA, 71 nt, Mycobacterium avium subsp. paratuberculosis
uuggcaccaaccuccgccccguuggcaccaaccuccgccccguuggcaccaagaaguggggggugugucaa

SEQ ID NO: 56670 - RNA, 124 nt, Mycobacterium avium subsp. paratuberculosis
uuucagggcggcgacccgcaguaacugaacggucagguugguggcucccaguaucgggaacaacccgauguagaugcgcagcgaucugaccccgugcaguucgagggugcugaacacgaugaag

SEQ ID NO: 56671 - RNA, 77 nt, Mycobacterium avium subsp. paratuberculosis
uuggggguguuaugagagucucaugggcaucaucggucacauggguaccgguuugccuaccaugagaucacucccaa

SEQ ID NO: 56672 - RNA, 58 nt, Mycobacterium avium subsp. paratuberculosis
uuguccgaucgaaccauagucucccgcccacaggcggugcaaggggcgaucgcggcaa

SEQ ID NO: 56673 - RNA, 103 nt, Mycobacterium avium subsp. paratuberculosis
ggcacucgucguggcggugcucuuggugguggucgucgacgagcccgccggcggguuggccgucgaacugcagccggccaacagcagcgccgcggccggugcc

SEQ ID NO: 56674 - RNA, 59 nt, Mycobacterium avium subsp. paratuberculosis
ggcaucaggaaagucuugagccccaaugcuuucagcucguccagggucuuucuggugcc

SEQ ID NO: 56675 - RNA, 80 nt, Mycobacterium avium subsp. paratuberculosis
ggcagggacgcgcucgucggccggugcgccccggggccgaacccgccguggccuugccgccggaugaucgccgccccgcc

SEQ ID NO: 56676 - RNA, 76 nt, Mycobacterium avium subsp. paratuberculosis
ggcagccgaccccguaucgcuggcugccgccgcgguguucagugaacguggcagccagcauucggccgcggcgacc

SEQ ID NO: 56677 - RNA, 78 nt, Mycobacterium avium subsp. paratuberculosis
ggcccaacgacccggcgaccaaggccgcccugcaggugcugaccgcgcugcggcccgaggucgagggucaggugggcc

SEQ ID NO: 56678 - RNA, 64 nt, Mycobacterium avium subsp. paratuberculosis
ggccaccgcugcgggcccgcuggucggagggacccuucuucgccuugggcucccaguggucgcc

SEQ ID NO: 56679 - RNA, 55 nt, Mycobacterium avium subsp. paratuberculosis
ggccagcacgguguugacgguggacaggauguagucgaugucggccuugguggcc

SEQ ID NO: 56680 - RNA, 58 nt, Mycobacterium avium subsp. paratuberculosis
ggccagcagggugggguuacgguagguguugccggugaccagggugcccagcuggacc

SEQ ID NO: 56681 - RNA, 64 nt, Mycobacterium avium subsp. paratuberculosis
ggcccguuccagcucggcgagcgugcgggcgucgacggccgccuggucgccgaguuggcgugcc

SEQ ID NO: 56682 - RNA, 60 nt, Mycobacterium avium subsp. paratuberculosis
ggcccguugagccgcaccaucaaacgcaucaucgacccguugguguugcggcugcggucc

SEQ ID NO: 56683 - RNA, 76 nt, Mycobacterium avium subsp. paratuberculosis
ggcccgcggcgaucccacccagguacgagccgaugaaccggagugugaccuccggugggcugaucgccggcgcgcc

SEQ ID NO: 56684 - RNA, 121 nt, Mycobacterium avium subsp. paratuberculosis
ggccgaaguccugggcgaucuggccgaucaggaucaggugcucgggcuugaugucgccgccgggcacccagggcaccaccgaguagcugccguucuuuuggauguuggccaggaagugguc

SEQ ID NO: 56685 - RNA, 75 nt, Mycobacterium avium subsp. paratuberculosis
ggccgacgggugcuuggucacccugaccucaccgaggacguccugggugcgggugcccagcaccgugacgcgguc

SEQ ID NO: 56686 - RNA, 80 nt, Mycobacterium avium subsp. paratuberculosis
ggauuuccagcaacgccuugagacaggacacgucggcggucagcagaaugccuugugccagcgucucggcgucgguuucc

SEQ ID NO: 56687 - RNA, 65 nt, Mycobacterium avium subsp. paratuberculosis
ggaucugggcccgcugcuggcgcgggacaaggcguucgcccagcagcugcaggccgacagcaucc

SEQ ID NO: 56688 - RNA, 83 nt, Mycobacterium avium subsp. paratuberculosis
ggauggucaccggcccgaucugcgcggaguugugcacgugcgugccgccgcagagcuccagcgagaacgggccgccgaucucc

SEQ ID NO: 56689 - RNA, 59 nt, Mycobacterium avium subsp. paratuberculosis
ggagcccggagaccauguucgccgagcagaacaagcugcuggcccccguguucuccucc

SEQ ID NO: 56690 - RNA, 76 nt, Mycobacterium avium subsp. paratuberculosis
ggcggccccagccgagcgugcaccggcagcugcacccagcucuugcagccggcguaguccggcgugcgggccagcc

SEQ ID NO: 56691 - RNA, 55 nt, Mycobacterium avium subsp. paratuberculosis
ggcggcgaucuguucggccgagguguccuccacgcccugggccaaaaaucgcacc

SEQ ID NO: 56692 - RNA, 69 nt, Mycobacterium avium subsp. paratuberculosis
ggcggcgcaugccucacucucgcaacggucuugaacgcugcgggcgagaccgcgggagcgcgcgccgcc

SEQ ID NO: 56693 - RNA, 76 nt, Mycobacterium avium subsp. paratuberculosis
ggcggcgccggcgaucacgguggacugcggugaggccaccacugccaccacaacaucgcugauuccgcgugccguc

SEQ ID NO: 56694 - RNA, 81 nt, Mycobacterium avium subsp. paratuberculosis
ggcgcgcggccggcccgcagggggugggcgcgcaucgcgacgccggugugcucacgcugcugcuggccgagccgggcagcc

SEQ ID NO: 56695 - RNA, 75 nt, Mycobacterium avium subsp. paratuberculosis
ggcgcggggguugagcccggccgagguggucgacguccggaccggccuggccgacaccaaccccgaaguggcgcc

SEQ ID NO: 56696 - RNA, 93 nt, Mycobacterium avium subsp. paratuberculosis
ggcgccgagugcgggccgaucgccuaucccgccgucaccaaacccccggugggcuggauaacacaggacgacggccgggugacgcugggcgcc

SEQ ID NO: 56697 - RNA, 103 nt, Mycobacterium avium subsp. paratuberculosis
ggcgcgaucggccaccgcgcgcaucuggaccgccucguagccgcccuuggaggcgaucgccaugguggcguccaggaugcguuugcggcguucccgcugcgcc

SEQ ID NO: 56698 - RNA, 73 nt, Mycobacterium avium subsp. paratuberculosis
ggcgcgcaggcuggcaucgucggcgccggcgcgcaacagcgucucgacggcgccgacgaugcugucgcggguc

SEQ ID NO: 56699 - RNA, 89 nt, Mycobacterium avium subsp. paratuberculosis
ggcgcccagcgcgauggcgugccgggucugccgguagucggcauucguaugcccaacugccacaacgacucccgcguccgcgaaacgcc

SEQ ID NO: 56700 - RNA, 109 nt, Mycobacterium avium subsp. paratuberculosis
ggcgcagcgcaauucggcaaggagaacaucgcggucaucgcgaccgcggugguguacggcgugguggcgcuggucgcggugcuggucgccucccgguggcugcugcgcu

SEQ ID NO: 56701 - RNA, 107 nt, Mycobacterium avium subsp. paratuberculosis
ggccggcggcggccaguuccugacgccaguucuccgcgccgaucaccacguggaagaugucggugcgcgggaagcugucguagcgggugcgagcggcauggccggcc

SEQ ID NO: 56702 - RNA, 84 nt, Mycobacterium avium subsp. paratuberculosis
ggccggcugguggccgagccgucggccaccaccgcgaacuucgucgguggcugcagcucggccugcguggucaccagcacgguc

SEQ ID NO: 56703 - RNA, 55 nt, Mycobacterium avium subsp. paratuberculosis
ggccgcgcucaaacaccugggccuggcgggggccgaucaggugaugaacgcgguc

SEQ ID NO: 56704 - RNA, 67 nt, Mycobacterium avium subsp. paratuberculosis
ggccgcgugcaggcccgccacgucuccgucgggccacaccucggagacgagcgccuguaugaccgcc

SEQ ID NO: 56705 - RNA, 67 nt, Mycobacterium avium subsp. paratuberculosis
ggccgccggcagcgcagggucgaucggcagauaggccgcccccgacuugagcgcggccaggauggcc

SEQ ID NO: 56706 - RNA, 71 nt, Mycobacterium avium subsp. paratuberculosis
ggccgccucgcugguggccgcggugcugacggcgucggccgucggcuccgcgaucaccgccgaccucggcu

SEQ ID NO: 56707 - RNA, 61 nt, Mycobacterium avium subsp. paratuberculosis
ggccagcucggcgaucgcccguuguucacccaaaacgucugcggcugcgagguuuucggcc

SEQ ID NO: 56708 - RNA, 81 nt, Mycobacterium avium subsp. paratuberculosis
ggccguguccgaucagcaggucgaugcgguugcgcaucaacugguugcgcaccacgucgaucuccuugccgaucacgugcu

SEQ ID NO: 56709 - RNA, 79 nt, Mycobacterium avium subsp. paratuberculosis
ggccuaccgcaaugcuuuucggccguccgcccggcuggcgcggcccuacgugguggugucggccgacguuguggucgcc

SEQ ID NO: 56710 - RNA, 80 nt, Mycobacterium avium subsp. paratuberculosis
ggccucacucgccgaacgugaagcuaguuucacguucgcacgcgagcgugaaguuaacuucacgcucggcgguaggggcc

SEQ ID NO: 56711 - RNA, 68 nt, Mycobacterium avium subsp. paratuberculosis
ggccuuuguaggucaccuugaccucggcgaugagcagcccgauggucaggaugucgaccucgaacgcc

SEQ ID NO: 56712 - RNA, 105 nt, Mycobacterium avium subsp. paratuberculosis
ggcgacgacgcgcuccugcaaaugggcgcggauuugugccaacagcuguccuggggggcaucuccccagcagcuggaggggcucgcgcugcagcgcuccgacgcc

SEQ ID NO: 56713 - RNA, 89 nt, Mycobacterium avium subsp. paratuberculosis
gggacaccggcggcggccagcgcgucggcguaggcggccagcugcagcagcgcggucaccuucuccgagcgggccagcuugguguccac

SEQ ID NO: 56714 - RNA, 72 nt, Mycobacterium avium subsp. paratuberculosis
ggcuguucgcgcgcgccguagacguccagcacgaaaaccucguccgcggcguccagggcgcgaccgaacucc

SEQ ID NO: 56715 - RNA, 64 nt, Mycobacterium avium subsp. paratuberculosis
ggcuuucgaccugcagccggaugugcugacccgggguccagcccaguccuugcagucgcgggcc

SEQ ID NO: 56716 - RNA, 56 nt, Mycobacterium avium subsp. paratuberculosis
ggcugugcucgggcggcaggucguccucguaguagauggacuccaccgggcacacc

SEQ ID NO: 56717 - RNA, 70 nt, Mycobacterium avium subsp. paratuberculosis
gggccgaaggugucaucggcagcgcgccggccauacacccggcgggcugaccggcgauggccaucgaucc

SEQ ID NO: 56718 - RNA, 100 nt, Mycobacterium avium subsp. paratuberculosis
gggccaaccuugaaauucggccccuaguuuucaagguugaagcccuaaccucgaaaucucggggucggcgauaugccuugcugagcaggggcuuugguuc

SEQ ID NO: 56719 - RNA, 56 nt, Mycobacterium avium subsp. paratuberculosis
gggccaccucggcacccuggugaucgaagaucaugcagcgcgugcugguggugccc

SEQ ID NO: 56720 - RNA, 77 nt, Mycobacterium avium subsp. paratuberculosis
gggauugucgugguugagggugaucaggccgucguggcccucgaaggugugaaaacgcccgcgacuaccgcgaaacc

SEQ ID NO: 56721 - RNA, 129 nt, Mycobacterium avium subsp. paratuberculosis
gggauggucuugccgccgauuucgaccuccucgguggugguccgagugaccauggucagcggugucucgaaccgcaggcccuccucgaucgccaucgguaucaacgaccggucccgauagaccaucgcc

SEQ ID NO: 56722 - RNA, 108 nt, Mycobacterium avium subsp. paratuberculosis
ggcugcgcgugccugccguggucaggccgguggcgguguugcugacgacgauguucgucguugcggcgugcagcaauuccgacccgcugggagcgcaggugcgcagcc

SEQ ID NO: 56723 - RNA, 65 nt, Mycobacterium avium subsp. paratuberculosis
ggcucaacagaugucaauagugugaguucgcucgugggcuaucucacuuugaucaucucguagcc

SEQ ID NO: 56724 - RNA, 61 nt, Mycobacterium avium subsp. paratuberculosis
ggcucgacggcuggccggaagccaguccguucgccggcucuggccucggagccgccgagcc

SEQ ID NO: 56725 - RNA, 91 nt, Mycobacterium avium subsp. paratuberculosis
ggcucguucgccgccgccgagccgcagacccgggaggcgaucaucgaggaauucucccggggcgagcugcacggcggcagcugggacagcc

SEQ ID NO: 56726 - RNA, 129 nt, Mycobacterium avium subsp. paratuberculosis
ggcggugagcgcgucgacgaccgccgccucguucucgguguccagcgcgcuggucgccucgucgaccagcaguaugggcgccgguuugagcagugcgcgggcgaugcugacgcgcuggcguucaccgcc

SEQ ID NO: 56727 - RNA, 81 nt, Mycobacterium avium subsp. paratuberculosis
ggcguuggugcugugggaugaggugcaggugcacgccgccgcacccaacgugcacguggaauucacccgcuacaccgagcc

SEQ ID NO: 56728 - RNA, 130 nt, Mycobacterium avium subsp. paratuberculosis
ggcgugcuguacaacaucgcguuucccggggccuaccugugucuguccgcggcaucgcuggccuggauggcucugcgcugaaucgggcgcgaggucaggccgggaaguagcggauccgguugaucgcguu

SEQ ID NO: 56729 - RNA, 67 nt, Mycobacterium avium subsp. paratuberculosis
ggcguucgcccacaaguccgaggugcuggcagcgcauugccgcgacgugggcaccgacuucgacgcc

SEQ ID NO: 56730 - RNA, 64 nt, Mycobacterium avium subsp. paratuberculosis
ggcggucggcgggucaggcgagcagcgccgcgcgcaggcguugcacgucugccucgccgacccc

SEQ ID NO: 56731 - RNA, 69 nt, Mycobacterium avium subsp. paratuberculosis
ggcgguggggucguggcggcgguacauguuggcggugcggccggugaagccgccgcggcccagcucguc

SEQ ID NO: 56732 - RNA, 78 nt, Mycobacterium avium subsp. paratuberculosis
ggcguccagguuggcgauguccgcgccgccgcugcggucgagccgcagccaggccuccugcacggcguccugggcguc

SEQ ID NO: 56733 - RNA, 63 nt, Mycobacterium avium subsp. paratuberculosis
ggguugaugccgaccgucucgugguccagggcgcccacccgcgcgccgggacggucggcgccc

SEQ ID NO: 56734 - RNA, 56 nt, Mycobacterium avium subsp. paratuberculosis
ggucaccuccaucgcgacgucggacgccaggcacuucgacgccgcggagaugaacc

SEQ ID NO: 56735 - RNA, 59 nt, Mycobacterium avium subsp. paratuberculosis
gggugguggucaaucacgcucggcgaguucgcggcucgcaucgagauagcucaucgccc

SEQ ID NO: 56736 - RNA, 103 nt, Mycobacterium avium subsp. paratuberculosis
gggucgggcacgaaccggcgaucaugcuggccgccgcgcacaacaccuugggucaggacaagaauuugguggugguggucgacgaggcgcaguugcucgaucc

SEQ ID NO: 56737 - RNA, 60 nt, Mycobacterium avium subsp. paratuberculosis
gggucuggccaccaccaaacgccugcucgaccgcggcgcgcaggugguggucaucgaccu

SEQ ID NO: 56738 - RNA, 59 nt, Mycobacterium avium subsp. paratuberculosis
gggucuguccaccggcggcgaguacgucggcgcgaugaccuaccugguggagcaggccc

SEQ ID NO: 56739 - RNA, 68 nt, Mycobacterium avium subsp. paratuberculosis
gggugugccgcauccgugcggcgccggaccgcauaucgcggcuggccgacgcgcuggugcgacgcccc

SEQ ID NO: 56740 - RNA, 111 nt, Mycobacterium avium subsp. paratuberculosis
gggugcugauccaccagccgucgcugcagggcgugauccaggggcaguucuccgaccuggagauccaggccgccgagaucgagcggaugcgcacgcugauggagaccaccc

SEQ ID NO: 56741 - RNA, 63 nt, Mycobacterium avium subsp. paratuberculosis
ggguggucagcgcgaucuucaggccgucacccucgcggccgaccagauucucgcugggcaccc

SEQ ID NO: 56742 - RNA, 92 nt, Mycobacterium avium subsp. paratuberculosis
ggguguugaccacgcuggcccgcagcuuggccaggucucccucggugcggucgggguggcggugguagagcgcgucggugauggucaggccc

SEQ ID NO: 56743 - RNA, 113 nt, Mycobacterium avium subsp. paratuberculosis
gggcgagaccgccgaccagcucgccgcgcucggccagggccggguggaaagcgugcugugcgacgugacguccaccgcccaggucgaugcgcuguucgcgucggcccacgccc

SEQ ID NO: 56744 - RNA, 69 nt, Mycobacterium avium subsp. paratuberculosis
gggcgaugccuucgacaaggcgaagaacgacgacacguucuaccuuccgccggaggcguucaagagccc

SEQ ID NO: 56745 - RNA, 85 nt, Mycobacterium avium subsp. paratuberculosis
gggcgccacgucggguaucaccucgggcgaggccggcagcuugagcgguuggccgcguuggguggagacccgaaagcuggugccc

SEQ ID NO: 56746 - RNA, 64 nt, Mycobacterium avium subsp. paratuberculosis
gggcgcgcugugggguccggcgucgggcgcacgcuaccucgauccgcugggccuggucgcgucc

SEQ ID NO: 56747 - RNA, 76 nt, Mycobacterium avium subsp. paratuberculosis
gggcgggcaucagcagcgaccgcacgugcgccggggugacccgccgcagcgucucggcgucgucgaucagccccuc

SEQ ID NO: 56748 - RNA, 58 nt, Mycobacterium avium subsp. paratuberculosis
gggcgggucgaucugcagcgggaucagcggccgcacguugcccaggucgaccgcgucc

SEQ ID NO: 56749 - RNA, 55 nt, Mycobacterium avium subsp. paratuberculosis
gggggcgagcaccaacggggcaccgcuacgccagcggcccaugaguuuugccgcc

SEQ ID NO: 56750 - RNA, 57 nt, Mycobacterium avium subsp. paratuberculosis
gugccccagcagcucggugagcaccucggcggugugcucgccguagcgcggcggcac

SEQ ID NO: 56751 - RNA, 62 nt, Mycobacterium avium subsp. paratuberculosis
gugaccggcgccgacugguugcacgucgacgugauggacaaccacuucgugccgaaucucac

SEQ ID NO: 56752 - RNA, 112 nt, Mycobacterium avium subsp. paratuberculosis
gugccgcauccaagcgaugaccugaaccgucgaacguggaguuguugcggaaaaucggccggauccgcgcaacaaccccacguucggcgucacgacgaacgguagcgagcac

SEQ ID NO: 56753 - RNA, 105 nt, Mycobacterium avium subsp. paratuberculosis
gugccgcggucccggacacgugauggcgaucggcgggcacggccgcggcuaccggacggcgccacgcggaaucgccagcgcgccaacauguuucgggcccggcgc

SEQ ID NO: 56754 - RNA, 71 nt, Mycobacterium avium subsp. paratuberculosis
gugcagccgccgccggugcucaaggagggcgacgacugccccgacucgacgcuggcggucaaggggcugac

SEQ ID NO: 56755 - RNA, 79 nt, Mycobacterium avium subsp. paratuberculosis
gugcaggugaccgccgacgccgacgccgccgcggccgccgacggacugguggugcccggcgucggcgccuacgaggcau

SEQ ID NO: 56756 - RNA, 119 nt, Mycobacterium avium subsp. paratuberculosis
gugcggccgcgguguaggaggucgccggccugcugacggggucgcuggacagggugcggccguccagcucccacuucuugcggccgccgucgagcagcuugaccuucucguggccguac

SEQ ID NO: 56757 - RNA, 82 nt, Mycobacterium avium subsp. paratuberculosis
gugcggccugcaucgucggcgggcggguuaggagccgaacuuuuccagcagagccuugcgcugacgaucgccgagaccgcgc

SEQ ID NO: 56758 - RNA, 56 nt, Mycobacterium avium subsp. paratuberculosis
gugcuggcggucggcugcggcggcggccauaagggcggcccgagcaccaccagcac

SEQ ID NO: 56759 - RNA, 102 nt, Mycobacterium avium subsp. paratuberculosis
gugaagcucggcagccagauugacggguugcgcugcugccauaccugcuggggucaccacuucagccgcggcaccugcgcucguugcgguugccagcgucac

SEQ ID NO: 56760 - RNA, 60 nt, Mycobacterium avium subsp. paratuberculosis
gugaucgaugauggugguaagcauuucggcucccacggugccgauaccccaggcgaugac

SEQ ID NO: 56761 - RNA, 129 nt, Mycobacterium avium subsp. paratuberculosis
gucuccguagcccugcagguagguggccagccgggcgaccgucuucuucagccgcagcuguucgggcagauggucgccgacgguggcgaagcacgaccacacccgcacgcugucggggucgcggcccgc

SEQ ID NO: 56762 - RNA, 90 nt, Mycobacterium avium subsp. paratuberculosis
gucuucuuggccgcggcgaucuuggucucgcucagcucgguggucaccacccggccgcugccguugucgcggaccgcggcggccaggugc

SEQ ID NO: 56763 - RNA, 83 nt, Mycobacterium avium subsp. paratuberculosis
gucuugggcgagauguucagcccgccggcacggauguccgcggcgggcgcggucaccccguagcgggccagcaggucgucgac

SEQ ID NO: 56764 - RNA, 61 nt, Mycobacterium avium subsp. paratuberculosis
gucgugccagagccuuuccagcaggcccggcccuuugggcuccgcggguuccggcaucggc

SEQ ID NO: 56765 - RNA, 77 nt, Mycobacterium avium subsp. paratuberculosis
gucgcgcagguuucgacgagcuccugcgagcggcgggccgggcugcgcagcugguagacgacgacgccgagcgcgac

SEQ ID NO: 56766 - RNA, 95 nt, Mycobacterium avium subsp. paratuberculosis
gucgcugccggucagcaccgccgucaccugcccgaccauccggauacacccggcgaucaucgcgcaggcggcggccaccgcggccgugcagcugc

SEQ ID NO: 56767 - RNA, 79 nt, Mycobacterium avium subsp. paratuberculosis
gucggugcugcugcuguccguggggcuggccggguucugcguccacgccacccugcugggcaugcuggccggcaccaac

SEQ ID NO: 56768 - RNA, 55 nt, Mycobacterium avium subsp. paratuberculosis
gucgucgaucgcggcggccagcucgccggugggcuugucaccgccguccggcgac

SEQ ID NO: 56769 - RNA, 75 nt, Mycobacterium avium subsp. paratuberculosis
gucgucgcggcguguugcgguaucgucgccggucgcaaggcaaugugagaggugacgcaauugacgccgggcgac

SEQ ID NO: 56770 - RNA, 58 nt, Mycobacterium avium subsp. paratuberculosis
gugggccaacgugagcuccaguugcuuacgcaccagcagggguaacagguugggccgc

SEQ ID NO: 56771 - RNA, 79 nt, Mycobacterium avium subsp. paratuberculosis
guggcgugcgcggucgucaccgccgccgccuggucgucggccaguccgggcggcacggugacggccaggcgcgcgucgc

SEQ ID NO: 56772 - RNA, 63 nt, Mycobacterium avium subsp. paratuberculosis
guggcugggucuggucgccaacgucggucaggugcucaacggcgacgcgccgagcucggccgc

SEQ ID NO: 56773 - RNA, 68 nt, Mycobacterium avium subsp. paratuberculosis
guguugugaaaaguuugcgguuucagcauucugggaacagcgugucaagacgagcagaugacgcucac

SEQ ID NO: 56774 - RNA, 64 nt, Mycobacterium avium subsp. paratuberculosis
guucaaucccggcggugcgagcauugcgaaggcucccgcuuuucauucgcccguuggguuggac

SEQ ID NO: 56775 - RNA, 94 nt, Mycobacterium avium subsp. paratuberculosis
guucagccacugccgcgacgugguggccgcggugaccaaugcggguggauucggcauccugggcgccaccgcgcacagcccgcagcggcuggac

SEQ ID NO: 56776 - RNA, 79 nt, Mycobacterium avium subsp. paratuberculosis
guucgggauccaggaguuguccaccacgguguugacgucgacgaucgucagccucggccuggacagucgccuggccggc

SEQ ID NO: 56777 - RNA, 61 nt, Mycobacterium avium subsp. paratuberculosis
guugaggaacucgcugcgcaccucggacugggucugcuccagccaggcgcggcggcucagc

SEQ ID NO: 56778 - RNA, 88 nt, Mycobacterium avium subsp. paratuberculosis
guugaucgucaucuacgccgacuucaagggugaggcgggggccgacagcuuccgccacuucccgcagguugucgcggugaucuccaac

SEQ ID NO: 56779 - RNA, 70 nt, Mycobacterium avium subsp. paratuberculosis
gguggacaugguuucguucaccgggucgacggccaccgggcgcagcgugaugagcgaugccgccgccacc

SEQ ID NO: 56780 - RNA, 77 nt, Mycobacterium avium subsp. paratuberculosis
ggugccgguguccggaauaucagucaugccugcucaacccgguccggcuugacaucuauuccggacuucgugcugcu

SEQ ID NO: 56781 - RNA, 65 nt, Mycobacterium avium subsp. paratuberculosis
ggugcugcugguggcggccaccacggagaacccguccuucucggugguggcgccgcugcuguccc

SEQ ID NO: 56782 - RNA, 94 nt, Mycobacterium avium subsp. paratuberculosis
ggugcuggccgggguggagcgggcgcuggcgcuggacagcgaaccgccggacucgcuggccgaggccgacgcgcugcucaccgcggcgcagacc

SEQ ID NO: 56783 - RNA, 128 nt, Mycobacterium avium subsp. paratuberculosis
ggugcugggcuggaacuucggcgacggccaccugcacaacgaaugccucaucgaggcgcugcagcagcgcugcggguucgagccgggcgaggugcggguggugauccuggacgcccagcccauccacc

SEQ ID NO: 56784 - RNA, 100 nt, Mycobacterium avium subsp. paratuberculosis
gguggugguguucggguuggccagcuugguggugucgguccgggcgaacagcagcgacaccgacaccaccagcgcgauggcggccacgauggccgccacc

SEQ ID NO: 56785 - RNA, 69 nt, Mycobacterium avium subsp. paratuberculosis
gguugcuggcaccgcugcgcugggcgcugaucccguccggcgugcugcaggcggugaucacgcugaucc

SEQ ID NO: 56786 - RNA, 68 nt, Mycobacterium avium subsp. paratuberculosis
ggugccccuacuugucccgcucggagucggacggcccgucgcgccaggggcgggagguuuucggcacc

SEQ ID NO: 56787 - RNA, 76 nt, Mycobacterium avium subsp. paratuberculosis
ggugccgcccuggccggcgccgugcacccagaccagccagggucugggcccgucacggugccggcgcaggugcacc

SEQ ID NO: 56788 - RNA, 83 nt, Mycobacterium avium subsp. paratuberculosis
ggugcgccgggaaggugcugcgcggacucuugcuguagucgaucgagacgcagauccagccgagcagcaccauccggcucauc

SEQ ID NO: 56789 - RNA, 61 nt, Mycobacterium avium subsp. paratuberculosis
ggugacgccgcaucugcuggugaugacggcgacgccgauaccgcgcaccguggcgcucacc

SEQ ID NO: 56790 - RNA, 106 nt, Mycobacterium avium subsp. paratuberculosis
ggugaugaugucccccgccgcgauggccgccugcaccggcgccgcgccgcgccaggccggcagcagcgagaagugcagguugauccacccgugcgggggaaccgcc

SEQ ID NO: 56791 - RNA, 115 nt, Mycobacterium avium subsp. paratuberculosis
ggucgcagacgauccgcaucgucgaucccgaaaccagcacugagugcccaccgggaacggucggcgagaucugggugcauggugagaacguuucggcgggcuauuggcagcgacc

SEQ ID NO: 56792 - RNA, 88 nt, Mycobacterium avium subsp. paratuberculosis
ggucgagcuggagaagcugcgcaucgagguggucaaccguggcuucagcccgggccagaaccaccaggugcgcgaggaccuguucgcc

SEQ ID NO: 56793 - RNA, 80 nt, Mycobacterium avium subsp. paratuberculosis
ggucgcgggcauccaccuggagggcccgugguugagccgcgcccgcugcggcgcccacgacgcccgccggaugcgcgacc

SEQ ID NO: 56794 - RNA, 84 nt, Mycobacterium avium subsp. paratuberculosis
ggucggggaucgggcuuccggugcccagcagggugaccucgaucauggggccuaucuugcagggccuggagcuuggacacgauc

SEQ ID NO: 56795 - RNA, 100 nt, Mycobacterium avium subsp. paratuberculosis
ggucuggugcugggccugcugggcucgcugcggaucgggaaucgguucguccacaccggaaaaccgaccccggccggcuacgcgcaggcccgcaccgacu

SEQ ID NO: 56796 - RNA, 73 nt, Mycobacterium avium subsp. paratuberculosis
guccagcagcgcggccagcagcgcgugggaguuggccaccagcccggcgaucugcuggcugcgccggcccagc

SEQ ID NO: 56797 - RNA, 72 nt, Mycobacterium avium subsp. paratuberculosis
guccagcucgcccgcggccuggccggggcgccgcgcgcggugaugauggacgagccguucggcgcgcuggac

SEQ ID NO: 56798 - RNA, 55 nt, Mycobacterium avium subsp. paratuberculosis
guccuugcgcccguccaaggcgacggcauaccagccgcggucgggcagccagaac

SEQ ID NO: 56799 - RNA, 69 nt, Mycobacterium avium subsp. paratuberculosis
guccuggccggccaacggcugcgcaagaacgaccgcgucgucaucagcuggcugucggccaaccacgac

SEQ ID NO: 56800 - RNA, 57 nt, Mycobacterium avium subsp. paratuberculosis
gucgaccacacgccggggcacacucgcggaucgaugugcuuccgggugucgucggac

SEQ ID NO: 56801 - RNA, 90 nt, Mycobacterium avium subsp. paratuberculosis
gucgacguccucgcccgggugcugcggcuccacgaagucaaaccccuuggcguccauguaguucagcagccggcagacgaauucggagac

SEQ ID NO: 56802 - RNA, 66 nt, Mycobacterium avium subsp. paratuberculosis
gucgagcaccgcggugcugacgucgucgggauagccccguuuggccagccggccguguagcucggc

SEQ ID NO: 56803 - RNA, 61 nt, Mycobacterium avium subsp. paratuberculosis
guccaaggaguuucuggccggcaagaagucacugaccgacuucaccgugcagaacucggac

SEQ ID NO: 56804 - RNA, 72 nt, Mycobacterium avium subsp. paratuberculosis
guagcucgcuggaaaagauggguccgguccgugaaaaugggccgggcccaucgcuuuucugggaucgccugc

SEQ ID NO: 56805 - RNA, 65 nt, Mycobacterium avium subsp. paratuberculosis
guagccguggcccagcaugucgaucgaccagguccagaaauggucggcgugcgcggccagguugc

SEQ ID NO: 56806 - RNA, 73 nt, Mycobacterium avium subsp. paratuberculosis
guagcggcucagcgcguagaaguuguacuucucguuguaguacagcggcgcuucuucgcgcaugcgcugccac

SEQ ID NO: 56807 - RNA, 79 nt, Mycobacterium avium subsp. paratuberculosis
guagagggccaucgcgugagucucuguggugaaacgaccaaggaucacuaccgagaggaacaucgcgauggcccuggac

SEQ ID NO: 56808 - RNA, 55 nt, Mycobacterium avium subsp. paratuberculosis
guaccggccguccuggaggccuucgaccagaugggccucccacagcgggcggugc

SEQ ID NO: 56809 - RNA, 101 nt, Mycobacterium avium subsp. paratuberculosis
uucuccucgccgaccagguuggucaccggcacccgcacgucggaguaauagguggcgcuggugucggggccggccauggugugcaccggcguccaggagaa

SEQ ID NO: 56810 - RNA, 74 nt, Mycobacterium avium subsp. paratuberculosis
uucucgccgucggccauguccuugaacgucgcggcgguaccgccgagauacacccgggcauccgacagcgagga

SEQ ID NO: 56811 - RNA, 58 nt, Mycobacterium avium subsp. paratuberculosis
uuaggucaccgugggcccaauccucaaacgagcccgguuuuggguccaaguauccuga

SEQ ID NO: 56812 - RNA, 56 nt, Mycobacterium avium subsp. paratuberculosis
uucagggucucgccgaucaccccgccgauccggucggugacggccugaccgcugga

SEQ ID NO: 56813 - RNA, 80 nt, Mycobacterium avium subsp. paratuberculosis
ugucgcagaugaccugcagcggcagcggcccggccagcucgcugaccagcuccgccuccccguuggggugauuggcgaca

SEQ ID NO: 56814 - RNA, 123 nt, Mycobacterium avium subsp. paratuberculosis
uguuggggaaguagcccuccagggugcggccguugagguugaacuugccggugcccggcaccagccgcacccgcaccacggccuccuugcggcggccgacggucuggaugggccgcucgaaca

SEQ ID NO: 56815 - RNA, 79 nt, Mycobacterium avium subsp. paratuberculosis
ugggucaggacggugacguguucgcgaacgagcaggucguggaacucguucggggagcgcgacaccguuucgggcacca

SEQ ID NO: 56816 - RNA, 87 nt, Mycobacterium avium subsp. paratuberculosis
uggccaccucccggauuuacuuaacguuagguaagccuagcauccgguuuacuuaucgguaagucaguuaagcugguggggugggca

SEQ ID NO: 56817 - RNA, 71 nt, Mycobacterium avium subsp. paratuberculosis
uggaggucaaccugcugaugggcgggcgcggggagaaacccggucugucucaggugcaggacgacccgccg

SEQ ID NO: 56818 - RNA, 102 nt, Mycobacterium avium subsp. paratuberculosis
ugcguuggugccgguggaggcgcugggcgcggugcucgaugccggagcggccgaguggccgccgcucgagcagccgaccagcgucaccgcggccgcagcgca

SEQ ID NO: 56819 - RNA, 130 nt, Mycobacterium avium subsp. paratuberculosis
ugcucgagcacaucggcguucaucgugccgaacgugcugugcgggcggugcuucaucccgucguugaaggccugcagaaugcgcguuuugaaauccgggcgcggauggguggcgaucaccgcggcgagcg

SEQ ID NO: 56820 - RNA, 61 nt, Mycobacterium avium subsp. paratuberculosis
ugcugggcggugccgcagccgacguccaccaggccguccuuggccugcgccacgcccggca

SEQ ID NO: 56821 - RNA, 56 nt, Mycobacterium avium subsp. paratuberculosis
ugcugcgcacuuugccgcuccugaccccaugccagguguggccaagacggccagca

SEQ ID NO: 56822 - RNA, 83 nt, Mycobacterium avium subsp. paratuberculosis
ugccggugauuucgcugacccggucggggguguacugcuccaggaagcugggcaucaccucccagcccucggugaacucggcg

SEQ ID NO: 56823 - RNA, 129 nt, Mycobacterium avium subsp. paratuberculosis
ugauuuucgaccugggcggcgauucgcugguccgcauuccgacgcuggagccgcugcgcggcagcaaggcgcaugucggagcguuauuggacucgguggauagcgccgccgagcuggucgaacaacuca

SEQ ID NO: 56824 - RNA, 60 nt, Mycobacterium avium subsp. paratuberculosis
ugcacugccgugaagagugcucgcgcaaccucauguguuccccgcgcgcuuugguaggca

SEQ ID NO: 56825 - RNA, 68 nt, Mycobacterium avium subsp. paratuberculosis
ugaaccgcgaccgauaguccggggaaugccggucgaagugauaccgguucuucuuacggucgcuguca

SEQ ID NO: 56826 - RNA, 57 nt, Mycobacterium avium subsp. paratuberculosis
ucucggccggccgcgccgugucgauccacuucgaaccgugcagcgcggcggccgaga

SEQ ID NO: 56827 - RNA, 64 nt, Mycobacterium avium subsp. paratuberculosis
ucugcgccggggcaucgccggaauggccaaugagggguggccauuuucccgagucccggcaaga

SEQ ID NO: 56828 - RNA, 70 nt, Mycobacterium avium subsp. paratuberculosis
ugagccgcgaaagugcaaccagcgacguguuucccgagaggcagcgucgguagaugcacucucgcgguca

SEQ ID NO: 56829 - RNA, 65 nt, Mycobacterium avium subsp. paratuberculosis
ugaccgugccggccgggaugugcaccccgcccagggugguggucuugcgcgccagccggaagucg

SEQ ID NO: 56830 - RNA, 62 nt, Mycobacterium avium subsp. paratuberculosis
ucucauuccugagacuuucuugaauuaucgaaacucgaauguaagauucgccggggaagaga

SEQ ID NO: 56831 - RNA, 61 nt, Mycobacterium avium subsp. paratuberculosis
ucguucaccugacgguugaggcccgaggucagcucggccagccugggcaccaggucgacga

SEQ ID NO: 56832 - RNA, 126 nt, Mycobacterium avium subsp. paratuberculosis
ucguuggugugggugcugaucgcggcggugauccgcacgcugcagaaccagggguacgcgcacuggacgccgauccuggugaucuccagcaucguguucgccgccgcccuggugcucucgcugcga

SEQ ID NO: 56833 - RNA, 116 nt, Mycobacterium avium subsp. paratuberculosis
ucguaucagcgcgaguacggguuguccgccgacggcaucugcggcccggaaacguugcgcucguuguauuuucugaguucgcgggucaccggcggaucgccgcacgcgcugcgcga

SEQ ID NO: 56834 - RNA, 110 nt, Mycobacterium avium subsp. paratuberculosis
ucgguggcccggugcaaugcuguccagcgcgccgugucggaaacaugggugauggugugcccugggccugacauacgugcguuauagcaguacggcggcggcgcuacuga

SEQ ID NO: 56835 - RNA, 75 nt, Mycobacterium avium subsp. paratuberculosis
ucgucgccggcgcgggcgucccgguggugcucgacgccggcaucggcaccgccagcgaugccgcgcuggcgaugg

SEQ ID NO: 56836 - RNA, 58 nt, Mycobacterium avium subsp. paratuberculosis
ucgucgggcgcgccgaccaagcgaucauucgcggcggguucaaggugaugcccgacga

SEQ ID NO: 56837 - RNA, 97 nt, Mycobacterium avium subsp. paratuberculosis
ucggcgacccgggcgacuaucugauccggcccggcuucuggcacggcgccaucggcguggccgccugcuggcugggcggcgcgcgccgggucgccga

SEQ ID NO: 56838 - RNA, 57 nt, Mycobacterium avium subsp. paratuberculosis
ucggcucccuggcugccgcuggagcgggcgaugacgcuggacagcagcggggacugg

SEQ ID NO: 56839 - RNA, 76 nt, Mycobacterium avium subsp. paratuberculosis
ucgcugggagggucgcuaucugcgcggcgacgaccagcgcaagcuggccgagcagaucaaggugaucaaccggcgg

SEQ ID NO: 56840 - RNA, 61 nt, Mycobacterium avium subsp. paratuberculosis
ucggcagcagcuggcucagcgaggcggugcgcccgcccaggaaccaggucagcugcgccga

SEQ ID NO: 56841 - RNA, 65 nt, Mycobacterium avium subsp. paratuberculosis
ucggaccuggcgcaauuggcggacaugcuggacaccuacaccaccuucggccgggugcgccccga

SEQ ID NO: 56842 - RNA, 63 nt, Mycobacterium avium subsp. paratuberculosis
ucgccugcagauaguccagcguguccaggaaauccugguugacgcgcuccuucucguaggcgg

SEQ ID NO: 56843 - RNA, 58 nt, Mycobacterium avium subsp. paratuberculosis
ucgccugcggcaaugagcccuagcgcgaugcugcgucccgccucggugcccaggucga

SEQ ID NO: 56844 - RNA, 67 nt, Mycobacterium avium subsp. paratuberculosis
ucgaccugcggccgucggaugcggagcuggcuuucaccgccgacgucaccgaccggucgcagguaga

SEQ ID NO: 56845 - RNA, 91 nt, Mycobacterium avium subsp. paratuberculosis
ucgauccguucacccgcgaacagaccgagcuguuggccggcgcgguguugggugggccggucgacacgcgguugguggaugagcuguucga

SEQ ID NO: 56846 - RNA, 59 nt, Mycobacterium avium subsp. paratuberculosis
ucgauuucggugaacgucagcguggacaagaucaugcugggaucgcuccccgacaucgg

SEQ ID NO: 56847 - RNA, 103 nt, Mycobacterium avium subsp. paratuberculosis
ucgaugggaaagcccagccgguacagccgagcgaagaucgugaccaccugcggcgccaggucuuggugcacgaucagcucgccccgguggguuuggccgucga

SEQ ID NO: 56848 - RNA, 82 nt, Mycobacterium avium subsp. paratuberculosis
ucgcccagcgcgggcagcggcugauuuugcgggccgcccggggugcggccccggccgucgccguagagcagucccgggguga

SEQ ID NO: 56849 - RNA, 79 nt, Mycobacterium avium subsp. paratuberculosis
ucgccgggcugggcgcggacuggacggccgccaacaucgccggugugcugguggagcagguccgcgcgcagaucggcga

SEQ ID NO: 56850 - RNA, 67 nt, Mycobacterium avium subsp. paratuberculosis
ucgccguccacgccgugcagcgcgaucaccggacgcagcaucccggucugccccggcgggauggcga

SEQ ID NO: 56851 - RNA, 57 nt, Mycobacterium avium subsp. paratuberculosis
ucaggaugaagccgacuucgaccuccacccgcggguagagguagcgguucgucuuga

SEQ ID NO: 56852 - RNA, 76 nt, Mycobacterium avium subsp. paratuberculosis
ucccguuccagcuggucgacgccgccagcgggcacgugcuggcccaggcggugcuggccgcgcugcucaaccggga

SEQ ID NO: 56853 - RNA, 71 nt, Mycobacterium avium subsp. paratuberculosis
uccccagcgccucggcggcgcuggccaugguguuggccguguacaugccgccgcaggcgcccucgccggga

SEQ ID NO: 56854 - RNA, 55 nt, Mycobacterium avium subsp. paratuberculosis
uccugcgccgccacgacagcaacugguacgaccccacgcugcggcugcagcagga

SEQ ID NO: 56855 - RNA, 59 nt, Mycobacterium avium subsp. paratuberculosis
uccugacuugcuucugucgcccacauugccgaaucgauaccgcaagggccuagucggga

SEQ ID NO: 56856 - RNA, 56 nt, Mycobacterium avium subsp. paratuberculosis
uccgccggcucugagucgccgucgauuccucuuccggugcacaucgacccggcgga

SEQ ID NO: 56857 - RNA, 75 nt, Mycobacterium avium subsp. paratuberculosis
uagugacucaagauacguccgcaucgcgcccccugaccagcgacguaacgggcagcgaugcggccggucucacug

SEQ ID NO: 56858 - RNA, 60 nt, Mycobacterium avium subsp. paratuberculosis
uagucgaaggcgcguuccagcgccggaaaguauuccagcagcugggcgcgcauucgguug

SEQ ID NO: 56859 - RNA, 66 nt, Mycobacterium avium subsp. paratuberculosis
ucacgccgaacugcuggcccggcacaguguguacuacgcgaugacccaggcauagcggugggcgga

SEQ ID NO: 56860 - RNA, 98 nt, Mycobacterium avium subsp. paratuberculosis
guuguucggcggcgcgcacgcugcgguccagcuuggggaucggguuggcgccccacacccgcugcgagaucagcaggcacggcgcgugcacggacagc

SEQ ID NO: 56861 - RNA, 56 nt, Mycobacterium avium subsp. paratuberculosis
guugguggaucgucgcgaaguccuuguggcgcaacgcacugcgacgaucaaccggc

SEQ ID NO: 56862 - RNA, 69 nt, Mycobacterium avium subsp. paratuberculosis
guugcgacaguucggcuuugagcucgucgagccggucggcgcggcgcgcgcacagcgcgaggucgcggc

SEQ ID NO: 56863 - RNA, 122 nt, Mycobacterium avium subsp. paratuberculosis
uacaccugcgggcugaaccgccgguugagccgcaguuccucgucgcagucggcgcggcguugcucgaugcuggugaagucgaggaagcccagguucaccggcuucuucagcuuguaggcgua

SEQ ID NO: 56864 - RNA, 58 nt, Mycobacterium avium subsp. paratuberculosis
gccuggaccuggacuggcgcccgcaauuccggguggaccuggucccguccuacaaggc

SEQ ID NO: 56865 - RNA, 77 nt, Mycobacterium avium subsp. paratuberculosis
gcgaaacgugguggcgcagaccaagaccgggucagcccacgaggucgucauggucggugcgcaccuggacggcucgc

SEQ ID NO: 56866 - RNA, 77 nt, Mycobacterium avium subsp. paratuberculosis
gcgaaagauguuggccagccacgcguccggcuugaguucgucguaggcgggcgcgggguugucgaucucguauucgc

SEQ ID NO: 56867 - RNA, 61 nt, Mycobacterium avium subsp. paratuberculosis
gcgaacuggcgaugagccucggagcgccggcccagugccuccagcgccaucaccagcucgc

SEQ ID NO: 56868 - RNA, 94 nt, Mycobacterium avium subsp. paratuberculosis
gcgaccgcggaggcgaucaccuuggucagcagcgcggcgcugcggauggcgucgucguugcccgggaucggguagucgaccucgucggggucgc

SEQ ID NO: 56869 - RNA, 107 nt, Mycobacterium avium subsp. paratuberculosis
gcgaggccagccgcaucugcgccagccucggccugccggaacgggugcugacgcagcagcugcgcacccuguccggcgggcagcgccgccggguggagcuggcccgc

SEQ ID NO: 56870 - RNA, 72 nt, Mycobacterium avium subsp. paratuberculosis
gccugguugucgggaaggcuggucggcucgugcgaucuaccucgacgagcuguggguuuccagguagcgggc

SEQ ID NO: 56871 - RNA, 60 nt, Mycobacterium avium subsp. paratuberculosis
gcgagcagacgcgaaagcacccgacacgccgauguuuugggugcuuuugugucugcucgc

SEQ ID NO: 56872 - RNA, 90 nt, Mycobacterium avium subsp. paratuberculosis
gcgagccaucgggucaccggauggucgaugacggcgaugccgucgcccucgagcacgucgucgagcacuucggugaagccgaccgccagc

SEQ ID NO: 56873 - RNA, 60 nt, Mycobacterium avium subsp. paratuberculosis
gcgccaucaccggccacaggguccagaucgaaaacgccacguggucaccggcgauggugc

SEQ ID NO: 56874 - RNA, 64 nt, Mycobacterium avium subsp. paratuberculosis
gcgccgagcgucacgccagcgugaccgucgcgcccgggugccacgccagcgugacgcucggugc

SEQ ID NO: 56875 - RNA, 111 nt, Mycobacterium avium subsp. paratuberculosis
gcgcagcugcccuugccggacucgucggucgauguuguggucaacuuccaggugaucgagcaucugugggaccaaacacaauucgucgucgagugcgcgcgggugcugcgc

SEQ ID NO: 56876 - RNA, 88 nt, Mycobacterium avium subsp. paratuberculosis
gcgaugagcucggcggccaggucggguccgggcggcacgccgucggcgggcugcacgacggccuugacuuccucgccgaauucgucgu

SEQ ID NO: 56877 - RNA, 93 nt, Mycobacterium avium subsp. paratuberculosis
gcgccggcacaaguggacccggcugggcgccuacgcgcaguccaagcucgcggucaugcugugggggcucgagcuggaccgccggcugcgcgc

SEQ ID NO: 56878 - RNA, 57 nt, Mycobacterium avium subsp. paratuberculosis
gcgccggcgugucggcgccaccggguaagugucguggggcucagccgaagccggcgc

SEQ ID NO: 56879 - RNA, 87 nt, Mycobacterium avium subsp. paratuberculosis
gcgcgacgugcugggcuggcgcgccgccgaggucgccgaggcgaucggcaccaccacggccgccgucaacagccugcugcaacgcgc

SEQ ID NO: 56880 - RNA, 62 nt, Mycobacterium avium subsp. paratuberculosis
gcgccugcacgucggaggcggcgccgaccauguuggucaggauguggcugaccugcaggugc

SEQ ID NO: 56881 - RNA, 81 nt, Mycobacterium avium subsp. paratuberculosis
gcgcggaguucuugcgcccgggcccggguuggggcgguuccugccugcccaaggacaccgcggcgcugcuggacaucgcgc

SEQ ID NO: 56882 - RNA, 65 nt, Mycobacterium avium subsp. paratuberculosis
gcggcuugacgugcucggcgcucagcggcucuuugagcagcggguuguccagcagguagaucugc

SEQ ID NO: 56883 - RNA, 78 nt, Mycobacterium avium subsp. paratuberculosis
gcgggcggucgacuucacgcugggcuacgaggugcgcucggucaacgccgaccccgagucccggccggccgucaucgc

SEQ ID NO: 56884 - RNA, 70 nt, Mycobacterium avium subsp. paratuberculosis
gcgggccgucaggacgaagccgaaugucucgacguaguagucgaucaguuuggguacguuaugggcuugc

SEQ ID NO: 56885 - RNA, 72 nt, Mycobacterium avium subsp. paratuberculosis
gcggucggcgaauggcagcagcaucgugguggcgcugaagcgcucggcgaugguguuggccaacagcaccgc

SEQ ID NO: 56886 - RNA, 113 nt, Mycobacterium avium subsp. paratuberculosis
gcgucaugggagcugggcgccucgaucgcggccggggucaauuaccugcgggugcucaccgaaucgggguugacgaucgcugcggcguugcgccagaucagcuuccgguucgc

SEQ ID NO: 56887 - RNA, 120 nt, Mycobacterium avium subsp. paratuberculosis
gcgugcucacggugaccgcaucgccgucggcggcgccgaucucggcggcggugucggccgacagccgcagcacgggcuggcgcgccgugccggccagaugcgguucgccgucuugcaugc

SEQ ID NO: 56888 - RNA, 70 nt, Mycobacterium avium subsp. paratuberculosis
gcgucggaaaccgucgacaucgcgcggcagggcuugaucgagcugcucgacaucgacgagauccaggcgc

SEQ ID NO: 56889 - RNA, 89 nt, Mycobacterium avium subsp. paratuberculosis
gcgucuccgggucgagcagcggcgacggcgccuccucgaugaccuuuugauggcgccgcugcaggcugcacucgcguucgccgagaugc

SEQ ID NO: 56890 - RNA, 81 nt, Mycobacterium avium subsp. paratuberculosis
gcggcaaccccaucggcagcaugcucuccucguggucgaguucgcguucgaucgcgcgcaggcucuggucgggcagcaugc

SEQ ID NO: 56891 - RNA, 57 nt, Mycobacterium avium subsp. paratuberculosis
gcggccgucggagacuggaugcuuuuggcggccauccaggcguugaucgacggccac

SEQ ID NO: 56892 - RNA, 99 nt, Mycobacterium avium subsp. paratuberculosis
gcggcgaccugagcguaggucaccaucacgccgugguacuccggcgcgauccgcggguugcuguuggagaaccgcggguccagcgccaggccgugccgc

SEQ ID NO: 56893 - RNA, 100 nt, Mycobacterium avium subsp. paratuberculosis
gcggcgaucggggccagcgugcugggcgcggugguggccgccaucggcauggcgcacgccgucgcgcccaccacccuggcgguccugauguugcugccgc

SEQ ID NO: 56894 - RNA, 86 nt, Mycobacterium avium subsp. paratuberculosis
gcggcggcgaacacgaugcuggagaucaccaggaucggcguccagugcgcguaccccugguucugcagcgugcggaucaccgccgc

SEQ ID NO: 56895 - RNA, 98 nt, Mycobacterium avium subsp. paratuberculosis
gcgcgucgacggcguggaccaccugcuuggacuccucggggauguccaugacaccgaccgggaacaucaggcccggguucugcccauagucgacgugc

SEQ ID NO: 56896 - RNA, 68 nt, Mycobacterium avium subsp. paratuberculosis
gcgcgggucgcgcccgggcaggucaccgccgucgaccaggcggcggacguccuggauguggcccgcgc

SEQ ID NO: 56897 - RNA, 103 nt, Mycobacterium avium subsp. paratuberculosis
gcgcgcggccgcggcggcggccgugcauuccaacgagcugggcuacucggugucgcugggcacgccggagcugcgggccgcgaucgccgcggacuaccggcgc

SEQ ID NO: 56898 - RNA, 95 nt, Mycobacterium avium subsp. paratuberculosis
gcgcgcggcgaccgcucuggcugacgucagcgacuucgccgcguuggcggccgcgguggacgaggccgucggccgacucggucgccuggacgugc

SEQ ID NO: 56899 - RNA, 91 nt, Mycobacterium avium subsp. paratuberculosis
gcgcggguccaucgccagcgcgccgcggguggaguugcgcagccaggagccgaaccgcggccggcccaucucggggcgcucgaacucgcgc

SEQ ID NO: 56900 - RNA, 58 nt, Mycobacterium avium subsp. paratuberculosis
gcugggcaccgugccgugaugcugcagcuggaaccacagcaugaagccggugcucagc

SEQ ID NO: 56901 - RNA, 59 nt, Mycobacterium avium subsp. paratuberculosis
gcuggccgagcucaagauccaugccgccacggucacgcuggccagcgagcugggccggu

SEQ ID NO: 56902 - RNA, 83 nt, Mycobacterium avium subsp. paratuberculosis
gcugcgcccggaccuggacugggacaagggcaagacgcugcacugggugaucgagcaccugcgccgguccgggucgggugcgc

SEQ ID NO: 56903 - RNA, 56 nt, Mycobacterium avium subsp. paratuberculosis
gcugcaucgcgaaccggucgccgccgaccagcgcggcgaccucggucgcgugcggc

SEQ ID NO: 56904 - RNA, 57 nt, Mycobacterium avium subsp. paratuberculosis
gcugccagucggccgccuuggucagcacgaaggugcgggucaugucggagugguagc

SEQ ID NO: 56905 - RNA, 59 nt, Mycobacterium avium subsp. paratuberculosis
gcugcccggcuucaucgacucgaccgccgcggcggucaccagucgcggcgccgggcggc

SEQ ID NO: 56906 - RNA, 67 nt, Mycobacterium avium subsp. paratuberculosis
gcugcugaccuccgacgagcugaccaggcugaugcgcaucgcggucacccgguugggggucaccagc

SEQ ID NO: 56907 - RNA, 60 nt, Mycobacterium avium subsp. paratuberculosis
gcugcuguuggccugggccgacuaccucaauucgcgguggcaggccggccugaugguggc

SEQ ID NO: 56908 - RNA, 83 nt, Mycobacterium avium subsp. paratuberculosis
gcugcucgacgagggauugggcgcgguggacgccgacuucaugaagaaggcccagucgcggcugcagggccucgucgagcggu

SEQ ID NO: 56909 - RNA, 60 nt, Mycobacterium avium subsp. paratuberculosis
gcugaccccggcgcgccagucggccuugaucaccgugcugacccgcggcgcccgggcggc

SEQ ID NO: 56910 - RNA, 84 nt, Mycobacterium avium subsp. paratuberculosis
gcucccggagggaucaggcuugcgcuggcaacucaaccgcgcgcugcggcgggccggcguucaagcccacaucgccuucgaagc

SEQ ID NO: 56911 - RNA, 67 nt, Mycobacterium avium subsp. paratuberculosis
gcucgacguggcggccgcgcgcgauggucgccuguuuggcggcgcgggcguuggccacccagucggc

SEQ ID NO: 56912 - RNA, 86 nt, Mycobacterium avium subsp. paratuberculosis
gcucgagcugcucgcgcuggggcggcccgguggguugcggcugcugggccaucgaccgcggcgcgucguccaccagcgggucgggc

SEQ ID NO: 56913 - RNA, 55 nt, Mycobacterium avium subsp. paratuberculosis
gcucaucgucgccaucaguucgucggccgacgcgaagugcugcgcgaugauaagc

SEQ ID NO: 56914 - RNA, 81 nt, Mycobacterium avium subsp. paratuberculosis
gcuagcugccgagcguggccggauccgggugcuguuggucgacgacgcccagcagcuggauccgcaggccgcgcggcuggu

SEQ ID NO: 56915 - RNA, 93 nt, Mycobacterium avium subsp. paratuberculosis
gcuacagcgccccguggucaccaucaguugccacgacgaccucaccagcuccgaccucgucgggcgcuucauggugaccggcggcgacguggu

SEQ ID NO: 56916 - RNA, 59 nt, Mycobacterium avium subsp. paratuberculosis
ggacgucgagcacgacgaugucgccggggcagacccggcgcagcagucggucgauguuc

SEQ ID NO: 56917 - RNA, 56 nt, Mycobacterium avium subsp. paratuberculosis
ggacguguccaaacugcaugccgccgguuugugggcgaccaugcagcaggaccgcu

SEQ ID NO: 56918 - RNA, 55 nt, Mycobacterium avium subsp. paratuberculosis
ggaccugcgacugcaccccaccccgacgcacacggugacggcgaucugcggguuc

SEQ ID NO: 56919 - RNA, 70 nt, Mycobacterium avium subsp. paratuberculosis
ggaccagcugcuggcgccacugcagcccgguauggcggccccgccgcacccgauggcgccuggcagcacc

SEQ ID NO: 56920 - RNA, 63 nt, Mycobacterium avium subsp. paratuberculosis
ggacaagcugcgcgccggaccgugggaaagugagcaaacccacgagucgcugcgccgguuucu

SEQ ID NO: 56921 - RNA, 62 nt, Mycobacterium avium subsp. paratuberculosis
ggaauccacaucgccgacggcgugcccaacgacagguacuccggcucaccggugugggcgcc

SEQ ID NO: 56922 - RNA, 77 nt, Mycobacterium avium subsp. paratuberculosis
gcuucuccaccgucaccgcgaacuucgccaacgcccugcugguguggcuggccgaguucgcgcuggugguggucggc

SEQ ID NO: 56923 - RNA, 60 nt, Mycobacterium avium subsp. paratuberculosis
gccuccacccgcagagaucccaaggcgcgcaacgucauucggagcucgugggugaaccgc

SEQ ID NO: 56924 - RNA, 61 nt, Mycobacterium avium subsp. paratuberculosis
gccucgacgugcgugucgccgcgcaccugugccaccccgacaccgaggcgcacgucgacgc

SEQ ID NO: 56925 - RNA, 62 nt, Mycobacterium avium subsp. paratuberculosis
gccucgaggaccuggauucggcgcugaaggaaaccagccagcugaaccugauccucaagggc

SEQ ID NO: 56926 - RNA, 83 nt, Mycobacterium avium subsp. paratuberculosis
gccgggccagccgaaugucguugaugugcaccaucucugcgcggauccgcccgcgcagcgcgucggcgaugagcgggcccagc

SEQ ID NO: 56927 - RNA, 55 nt, Mycobacterium avium subsp. paratuberculosis
gccuaucagcucgagggcagggauucgaagcaucaccugcaugagcugguggcgc

SEQ ID NO: 56928 - RNA, 57 nt, Mycobacterium avium subsp. paratuberculosis
gccguugcggcgcaaccacuuucgguguucaucuucgacauccugcacugcgacggc

SEQ ID NO: 56929 - RNA, 55 nt, Mycobacterium avium subsp. paratuberculosis
gccguggugguuagcggcaugauggggugaugucuucuccggugaccaccacggc

SEQ ID NO: 56930 - RNA, 95 nt, Mycobacterium avium subsp. paratuberculosis
gccggaccgcgccgugcuggacuggcgguucgacgcgcugcaguucugagccgcacgcccgcgagcaccgccaugagcacggccgcgagcacggc

SEQ ID NO: 56931 - RNA, 78 nt, Mycobacterium avium subsp. paratuberculosis
gccggcgagcggaucuccaacgcgcugguggcgauggcgaucgagucgcugggcgcccaggcgcguucguucaccggc

SEQ ID NO: 56932 - RNA, 96 nt, Mycobacterium avium subsp. paratuberculosis
gccgguaugcggcgacgacgacaucggcgccccagaguuggccgccggucguggucagccgccaggcgucggcgucgucgucgaaccgggaccggc

SEQ ID NO: 56933 - RNA, 130 nt, Mycobacterium avium subsp. paratuberculosis
gccgggcggucccgcgauuucugggguccggccgcccggcuggucaaacagcuugcgccgcaacgucggacggccaucgcggugaucacgcugggcaucgccggcacggugaucggggugaucguuccgc

SEQ ID NO: 56934 - RNA, 113 nt, Mycobacterium avium subsp. paratuberculosis
gccggcggggcacaugggaagugcccgccucugagcgacaaucaccgaaguccgaucccccgacgcgucguugucgcucagaggcgggcaaaguuccuauuccccgggccggc

SEQ ID NO: 56935 - RNA, 55 nt, Mycobacterium avium subsp. paratuberculosis
gccggcguaguagcggaagaacuccgaacacgucgacaucugcagcugcgccugc

SEQ ID NO: 56936 - RNA, 84 nt, Mycobacterium avium subsp. paratuberculosis
gcccucggccuggccauggcguucggccgguuccugcccaucgugcuggugcuggcgcuggccggaucgcuggccaggcagggc

SEQ ID NO: 56937 - RNA, 75 nt, Mycobacterium avium subsp. paratuberculosis
gccgaauucauggaccucgugcaguacggccagauccgcgaggacugggccgcccuguaccggaaagccauuggc

SEQ ID NO: 56938 - RNA, 118 nt, Mycobacterium avium subsp. paratuberculosis
gcccugcucggcgcgacucuguaucgauucaagcaauucggacacgcgcuucaggguaagggcuacccauaaguaguccuaauugcccacgucggucuuagaucaggccgagcugggu

SEQ ID NO: 56939 - RNA, 100 nt, Mycobacterium avium subsp. paratuberculosis
gccgaccucaccguugaagcgcgagcagacgcaaaagcuccccgccgcccggcgugucgggugcuuucgcgucugcucgccggacgaccggggucccggc

SEQ ID NO: 56940 - RNA, 101 nt, Mycobacterium avium subsp. paratuberculosis
gccgacgacccggccgcggugugggccaacuacuuucccgccaccgacgcgcagauggcggccgagggccugggcuacuacugcggcggcgacccgucggc

SEQ ID NO: 56941 - RNA, 64 nt, Mycobacterium avium subsp. paratuberculosis
gccgacgccggcuucaccgccguccacagcgagaccaugcccggcugggaagccggcaucgugc

SEQ ID NO: 56942 - RNA, 68 nt, Mycobacterium avium subsp. paratuberculosis
gccgagauuccgacgaccuguaccgcuaccugcgcgagcaacucggccagcucgacggggugcucggc

SEQ ID NO: 56943 - RNA, 60 nt, Mycobacterium avium subsp. paratuberculosis
gccgagcgugcagccacggcgauuuuuucgcgauuuuuucgccaugagugcacguugggc

SEQ ID NO: 56944 - RNA, 59 nt, Mycobacterium avium subsp. paratuberculosis
gccgcccggcgccgcgacuggugaccgccgcggcggucgagucgaugaagccgggcagc

SEQ ID NO: 56945 - RNA, 76 nt, Mycobacterium avium subsp. paratuberculosis
gccgccgcgcccgagcgucacgcuggcgugacacucggcgccggccgucacgccagcgugacgcucggccgguggc

SEQ ID NO: 56946 - RNA, 81 nt, Mycobacterium avium subsp. paratuberculosis
gccgccgcgcgcuccgggcugaucgcccgcaccggguugagccggugcgacggcacgaucaucggggugcgcaccagcggc

SEQ ID NO: 56947 - RNA, 87 nt, Mycobacterium avium subsp. paratuberculosis
gccgcccccgccgcgagcagacacaaaagcgcccgauuccccggcgugucgcgugcuuuugcgucugcucgccagacucacggcggc

SEQ ID NO: 56948 - RNA, 74 nt, Mycobacterium avium subsp. paratuberculosis
gccgccugcagacccgcgccgucuggcggcuggucaacuuccugcucgagggcgugguguuccugcugaucggc

SEQ ID NO: 56949 - RNA, 57 nt, Mycobacterium avium subsp. paratuberculosis
gccgcggcaccgaugguguugagaccaaacagguuucgacguucuccacgcugcggc

SEQ ID NO: 56950 - RNA, 61 nt, Mycobacterium avium subsp. paratuberculosis
gccgcucguaacggcagggcgcaaaccgggccccggaaucgccguggcguuacgagcgagc

SEQ ID NO: 56951 - RNA, 91 nt, Mycobacterium avium subsp. paratuberculosis
gccacggugaugcggucaccgccgcgccggacgguuucgaggugguggccagcagccccggcgccgugguggccgcguucgagaaccgggc

SEQ ID NO: 56952 - RNA, 56 nt, Mycobacterium avium subsp. paratuberculosis
gccagcagccgcgaggugucacccaccugcugggcgaccucggacagcucgcuggu

SEQ ID NO: 56953 - RNA, 68 nt, Mycobacterium avium subsp. paratuberculosis
gccagcgaucacauccagccguggcaggacaacgagggccauucgauguuuccguggcugacgcuggc

SEQ ID NO: 56954 - RNA, 60 nt, Mycobacterium avium subsp. paratuberculosis
gccagcuggacuaccugcgccggaugaccgcguuccugcagcaggucauguucuagcggc

SEQ ID NO: 56955 - RNA, 69 nt, Mycobacterium avium subsp. paratuberculosis
gcccagcgggugcucggccugccgcgcgguuagcgccgucacagcgcuugccgagagacguugcugggc

SEQ ID NO: 56956 - RNA, 83 nt, Mycobacterium avium subsp. paratuberculosis
gcccgcagcccggccagcgugucguccgaacccguuguggcgcggcggguuugguccucgaucacgcgcgcggagucgcgggu

SEQ ID NO: 56957 - RNA, 123 nt, Mycobacterium avium subsp. paratuberculosis
gcccggucgccgucaccggcgucgccugcaggauccgccaggcgacuucgaaggacaucuucugcagcgcaaggcguuuggcgucgggguccugcgccagcgggccgugcggcgcacccaggu

SEQ ID NO: 56958 - RNA, 122 nt, Mycobacterium avium subsp. paratuberculosis
gcccggugaugaagguggcgucggugcugagcaggaaggccaccagcgcacccacgucggugcgcacgucgccgauccgcuucaucggcacccguccgaccgccuucgcauagucguugggc

SEQ ID NO: 56959 - RNA, 83 nt, Mycobacterium avium subsp. paratuberculosis
gcccgugaaauucgccuuucccguuccgcaccugaugcgccucaaggcgauugcgcagcccugggaagcggccgucaccgggc

SEQ ID NO: 56960 - RNA, 92 nt, Mycobacterium avium subsp. paratuberculosis
gcccgugcaacguggccucugcccgaaccgacccuggcguacuuccccaacgccagguucgugccuucggacagggaccucgaugcaggggc

SEQ ID NO: 56961 - RNA, 124 nt, Mycobacterium avium subsp. paratuberculosis
gcccgcccugcucggccuggcgcugcuggaggccgucgugguggccgccaucgccggacugguggugguggucaucgcgauccuggccacgaucggcaacgccgcggccgccguggugcugggc

SEQ ID NO: 56962 - RNA, 118 nt, Mycobacterium avium subsp. paratuberculosis
gcccaggugcucggccgccagcacggcgucggccagcugguccagcacgucggggugggugguuuugauggcgucgaucagcucgucgaggcggaccggguggacgaugcggaugggc

SEQ ID NO: 56963 - RNA, 57 nt, Mycobacterium avium subsp. paratuberculosis
gccaccaccgucugcucggcggccagcaccaccgccagcacccgcagccgggguggc

SEQ ID NO: 56964 - RNA, 60 nt, Mycobacterium avium subsp. paratuberculosis
gcauggcccugcccgucgucagcgccaagacggugcgcaucaacgacggcggcgccgugc

SEQ ID NO: 56965 - RNA, 96 nt, Mycobacterium avium subsp. paratuberculosis
gcauggccgucgccgaucugcgcgcggaccugcuccaccagcacaccggcgauguuggcggccguccaguccgcgcccagcccggcgaagucgugc

SEQ ID NO: 56966 - RNA, 130 nt, Mycobacterium avium subsp. paratuberculosis
gcagggcucccgcaucaucuaccgcaacccggacuucaauuccgguggugugcugaacgcucgcgaggauuucaucaccgcccacccggauuccguccaguugguggucgacaccuaugaggaggcccgc

SEQ ID NO: 56967 - RNA, 106 nt, Mycobacterium avium subsp. paratuberculosis
gcaguagggcucauuggccgucccccggugcgggugcggggucaaaaacggcgcauccguuuccaccagcagcugcccgggcgguaucaacggcacggcuucgcgc

SEQ ID NO: 56968 - RNA, 57 nt, Mycobacterium avium subsp. paratuberculosis
gagcucacccggcucgccgugcaccagaagaccggcgugcggagccggcugaugcuc

SEQ ID NO: 56969 - RNA, 60 nt, Mycobacterium avium subsp. paratuberculosis
gaguaauggucgguucuauguaaguuggaccgguucugccaacauaagagccgacgacuc

SEQ ID NO: 56970 - RNA, 71 nt, Mycobacterium avium subsp. paratuberculosis
gaggacaucgcguccgagaaguuguccaaugguguugcgcugggcgcacuuucgccggacgcggugucguc

SEQ ID NO: 56971 - RNA, 85 nt, Mycobacterium avium subsp. paratuberculosis
gagcggaucggcgaccgggccugggucaagcugaucagcucgcacgacaagcuggucucggaucuggugcggcgccaauccgguc

SEQ ID NO: 56972 - RNA, 82 nt, Mycobacterium avium subsp. paratuberculosis
gaucgccgugcugcugccgccgcagccgauggacaccgggaucgucggcuccuugcuggacggccugcacgcccuggugauc

SEQ ID NO: 56973 - RNA, 73 nt, Mycobacterium avium subsp. paratuberculosis
gaucgacggcgcgcgcucggucgugguggacgaugccgggcacuguccgcagaucgagcagccguccgugguc

SEQ ID NO: 56974 - RNA, 63 nt, Mycobacterium avium subsp. paratuberculosis
gaucucgucgaccgccacguccaggucggccagccgguccugccagucccgcucgauggguuc

SEQ ID NO: 56975 - RNA, 75 nt, Mycobacterium avium subsp. paratuberculosis
gaucugcuggugcuggcugaccagaaagucgaccacaucggugggcgacuugauggcggucggugccaugcuguc

SEQ ID NO: 56976 - RNA, 85 nt, Mycobacterium avium subsp. paratuberculosis
gaucaugcgacugaccggcaucaccacggcgauggugucggacgcgccggccaucgacgcggugcugccgauguuccucgaguuc

SEQ ID NO: 56977 - RNA, 56 nt, Mycobacterium avium subsp. paratuberculosis
gauccagcagcggccggucccgcucgucggucgagccagccagccguugccggauc

SEQ ID NO: 56978 - RNA, 78 nt, Mycobacterium avium subsp. paratuberculosis
gaguucgcccaguauggauuggccggcgcgcgcaucgaccgcaucgcgcgcgucgcccaggccagcaaggaacgccuc

SEQ ID NO: 56979 - RNA, 80 nt, Mycobacterium avium subsp. paratuberculosis
gauaccggucggacggauugccgaacaaggccagcgcugauacgugcucggccuggucggcguucagcgucugcggaauc

SEQ ID NO: 56980 - RNA, 60 nt, Mycobacterium avium subsp. paratuberculosis
gcaacugcucagccacuccuugaccuuacaacugucgcaaggucuguacugagcggaugc

SEQ ID NO: 56981 - RNA, 58 nt, Mycobacterium avium subsp. paratuberculosis
gauggugccgcggaacuucucgccgaacuccggugaguccagccagcgcgacaccauc

SEQ ID NO: 56982 - RNA, 58 nt, Mycobacterium avium subsp. paratuberculosis
gauggugucgcgcuggcuggacucaccggaguucggcgagaaguuccgcggcaccauc

SEQ ID NO: 56983 - RNA, 87 nt, Mycobacterium avium subsp. paratuberculosis
gauguagagggccaucgcgugagucucuguggugaaacgaccaaggaucacuaccgagaggaacaucgcgauggcccuggaccaguc

SEQ ID NO: 56984 - RNA, 78 nt, Mycobacterium avium subsp. paratuberculosis
gauggccucgcgcagcauguccugccggcgggugauggucggccagccuuugccgacgacaugcucguugagguuuuc

SEQ ID NO: 56985 - RNA, 108 nt, Mycobacterium avium subsp. paratuberculosis
gaugcgguucucccguucggcgaacggcaccagguucuucagcgccuugggguaggcgagcgagaagugcaccugguugcugaucaccggccggcccagcgccgcguc

SEQ ID NO: 56986 - RNA, 59 nt, Mycobacterium avium subsp. paratuberculosis
gcagcaggacgagcucaccucgcuggucgaaccgcaagacggugagccguucgugcugc

SEQ ID NO: 56987 - RNA, 62 nt, Mycobacterium avium subsp. paratuberculosis
gcagcacggccuccuccacgucgugcgucaccaaaaucguugugguaccggcccguugcugc

SEQ ID NO: 56988 - RNA, 84 nt, Mycobacterium avium subsp. paratuberculosis
gcagcagaccgacguugucaccggccuggcccuggucgagcagcuugcggaacaucuccacaccggugaccguggucuuggugc

SEQ ID NO: 56989 - RNA, 62 nt, Mycobacterium avium subsp. paratuberculosis
gcaggcgaugagccggguggccucggagaccgagcggaugacccggcuggucgaggaccugc

SEQ ID NO: 56990 - RNA, 68 nt, Mycobacterium avium subsp. paratuberculosis
gcagcugugguuggucaccaucaccgacgacgacgaccgcgucgucgcccgaggccaagugcggcugc

SEQ ID NO: 56991 - RNA, 71 nt, Mycobacterium avium subsp. paratuberculosis
gcaggcaggacggcaucgcgggccuggaccgugcccuacuggacgccgagcucgcgcugcugaccgcgggu

SEQ ID NO: 56992 - RNA, 107 nt, Mycobacterium avium subsp. paratuberculosis
gcaccgcguacaugucguccaugccgucguugcccugcgcggugcuggaguggaagagcagucccugcugcagcggggucagcggcaggaugucggcgaugcggugc

SEQ ID NO: 56993 - RNA, 76 nt, Mycobacterium avium subsp. paratuberculosis
cgggaucaccggguggcucaacaccccggacggcaaaccgcucgacccggcgguggugcgcggcaaggugauccug

SEQ ID NO: 56994 - RNA, 55 nt, Mycobacterium avium subsp. paratuberculosis
cggcugaucgcggucgagcucgacgucaccuccgagcaacaauggcgcucggccg

SEQ ID NO: 56995 - RNA, 65 nt, Mycobacterium avium subsp. paratuberculosis
cggcguggcuggccgucaucaccggcgccacgcuggugucggugucgugggcggccgccucgccg

SEQ ID NO: 56996 - RNA, 79 nt, Mycobacterium avium subsp. paratuberculosis
cggcguugucgcccuugaggaucagguucagcuggcugguuuccuucagcgccgaauccagguccucgaggcugauccg

SEQ ID NO: 56997 - RNA, 55 nt, Mycobacterium avium subsp. paratuberculosis
cgggcggcaaacccggugggagguggucgcgcacgccucuagccuacgcagcccg

SEQ ID NO: 56998 - RNA, 129 nt, Mycobacterium avium subsp. paratuberculosis
cgggcaucgucggcaguuggcccgucuggcccgccaugcccgggaucuggccggccaucgcgggaagcugcccgggcauucccggaaccugcggcauggcgccggaaagguugccgcuggcgauguucg

SEQ ID NO: 56999 - RNA, 94 nt, Mycobacterium avium subsp. paratuberculosis
cgggccuguucgguggcgucgaugcgaaucccggcggccgacgagaucgcgcccagcacggcgcauuccagcgccgccgaggacgacaggcccg

SEQ ID NO: 57000 - RNA, 59 nt, Mycobacterium avium subsp. paratuberculosis
cggucguuugaguccgccgacgauuucgagcgcgagauccaggcgcugcgcgagcaccg

SEQ ID NO: 57001 - RNA, 62 nt, Mycobacterium avium subsp. paratuberculosis
cggucccgcaaccggcucgccgaccgccagucgcgggcgauggcgacggauucgcgggucug

SEQ ID NO: 57002 - RNA, 61 nt, Mycobacterium avium subsp. paratuberculosis
cggugccgucgaucaacagcugcagcagguuggcccgcagcaugucccagucgugguagug

SEQ ID NO: 57003 - RNA, 94 nt, Mycobacterium avium subsp. paratuberculosis
cggugaucgcgucccagucgcgggcuuugaaauaggcgugcaggcgcucguaugcgcgugucgcgccauucucgagcggcggucgcggacaccg

SEQ ID NO: 57004 - RNA, 62 nt, Mycobacterium avium subsp. paratuberculosis
cgguggccgguguggccucugccaggcacuuuugcagaauggggguuggcacaugaucaccg

SEQ ID NO: 57005 - RNA, 96 nt, Mycobacterium avium subsp. paratuberculosis
cgguacugauguagagggccaucgcgugagucucuguggugaaacgaccaaggaucacuaccgagaggaacaucgcgauggcccuggaccagucug

SEQ ID NO: 57006 - RNA, 94 nt, Mycobacterium avium subsp. paratuberculosis
cgggugcgggcgcggauccugggcaucgccaagucgguguucgcggccaccgccgccaggcugggcgagcugcuagcugccgacgccgcacucg

SEQ ID NO: 57007 - RNA, 105 nt, Mycobacterium avium subsp. paratuberculosis
cgggucaguacgucggcgacggccuccuggaagccggccgcgacgucggcguucaccgcguccggguggcuuuccagguaccgcgccacggccgucuugagcccg

SEQ ID NO: 57008 - RNA, 80 nt, Mycobacterium avium subsp. paratuberculosis
cggcucuuguuguagucgaaggcgcguuccagcgccggaaaguauuccagcagcugggcgcgcauucgguugaucgcccg

SEQ ID NO: 57009 - RNA, 67 nt, Mycobacterium avium subsp. paratuberculosis
cgggucuggccgaugucauggcgaccgccgccgcgcagggggugguggcccggaucgacuggacccg

SEQ ID NO: 57010 - RNA, 59 nt, Mycobacterium avium subsp. paratuberculosis
cggcggugacggccacccgggcgcccagcgccugcgcgaccuggauggcguggcugccg

SEQ ID NO: 57011 - RNA, 64 nt, Mycobacterium avium subsp. paratuberculosis
cggcgagcagacgcaaaagcccccaaugucacggcgggucgggggauuucacgucugcucggcg

SEQ ID NO: 57012 - RNA, 129 nt, Mycobacterium avium subsp. paratuberculosis
cggcgcagguugucgcccaggccgaucggcgcguccgaggugguguccaccccgccggcggcggccacgucguagcggccggcggcgaugcccucggcggccgccaucgcggccugcaacccggugccg

SEQ ID NO: 57013 - RNA, 79 nt, Mycobacterium avium subsp. paratuberculosis
cggcgcgagcagcccggacaccgucucccggaucaccuccucgagacccacccaggucugccggcuggcggugcgcacg

SEQ ID NO: 57014 - RNA, 63 nt, Mycobacterium avium subsp. paratuberculosis
cggcgcgcccgcugaaugaacucgucgagcccggcugggcgcgugcguugcagccgguggccg

SEQ ID NO: 57015 - RNA, 104 nt, Mycobacterium avium subsp. paratuberculosis
cggcgcggcgaucgacggccuggugaucagcgccggcauccccgagcuggaggaggccgucgagcugaucgaggagcugggcgacgucggcaucagcaacgucg

SEQ ID NO: 57016 - RNA, 63 nt, Mycobacterium avium subsp. paratuberculosis
cggcgcggcgucacgcuggcgugacgcucgcuugcggcggucacgcuagcgugacgcucgccg

SEQ ID NO: 57017 - RNA, 80 nt, Mycobacterium avium subsp. paratuberculosis
cggcgcggguguccauucucggccgggugcacacuccguuggggacgcugucgcugccgcggguggagauccggaugccg

SEQ ID NO: 57018 - RNA, 74 nt, Mycobacterium avium subsp. paratuberculosis
cggccucggccaagggcccgcacgccaaacccgaggacauccgguucgggcuguacggcgcccuggcccacccg

SEQ ID NO: 57019 - RNA, 57 nt, Mycobacterium avium subsp. paratuberculosis
cggccugcaggcucacggcugcaacgaccguacggguugcagcgccgucugcagcug

SEQ ID NO: 57020 - RNA, 71 nt, Mycobacterium avium subsp. paratuberculosis
cggcgaccagguggccgcccgcacccccgacgaggagcugcgcggcugggcgcuggccgaccuggccgccg

SEQ ID NO: 57021 - RNA, 130 nt, Mycobacterium avium subsp. paratuberculosis
cggaucgccgaccugcaggugcgggcgacguaucuggccggccgccggguguacccacagugauuccgccgcugcaggaccugcuggaccggcugcacguggucgcgcugccgaugcgggugcgauuccg

SEQ ID NO: 57022 - RNA, 82 nt, Mycobacterium avium subsp. paratuberculosis
cggcaccaaccuggcguccgcguucagcuccaccaucaaggacgugucgcuggccaacugcggagacgccgggcagucgccg

SEQ ID NO: 57023 - RNA, 65 nt, Mycobacterium avium subsp. paratuberculosis
cggcacugcgccaccgguggaacggucgagguccgcgacacggccgagccggcggcgcggcgccg

SEQ ID NO: 57024 - RNA, 80 nt, Mycobacterium avium subsp. paratuberculosis
cggcccgccggcuucgcuggacugccacagguucgacgacgccgcggucugcuugcgguccggcaggaugcgguaggccg

SEQ ID NO: 57025 - RNA, 80 nt, Mycobacterium avium subsp. paratuberculosis
cggccagcucgccgaacugggcgcgcugccacagcguguagucgacguacugcaccggcagcggcguccagucggggccg

SEQ ID NO: 57026 - RNA, 67 nt, Mycobacterium avium subsp. paratuberculosis
cggcaagcccggccacgugcugccggccgagaucgccgaggccgcucccaccgccgggcugaugccg

SEQ ID NO: 57027 - RNA, 93 nt, Mycobacterium avium subsp. paratuberculosis
cggcauucaccguucgccgguacagcugcgaccacgucagggucucggcgaccccguuccagucccgcucguaaucgaugaaugugaacgccg

SEQ ID NO: 57028 - RNA, 96 nt, Mycobacterium avium subsp. paratuberculosis
cgcuggagucggcgcugcugcccgaccaggaccugccguugcggaucuucgagccccgcuacggcgcgcuggugcggcacugccuggacaccggcg

SEQ ID NO: 57029 - RNA, 56 nt, Mycobacterium avium subsp. paratuberculosis
cgcugcgagccgguauugugaucgacuccaugucggcggcgggcauggcuccagcg

SEQ ID NO: 57030 - RNA, 56 nt, Mycobacterium avium subsp. paratuberculosis
cgcgccgggccagcuccacgcacuggcgguggucgguguccagguugcccagcgcg

SEQ ID NO: 57031 - RNA, 70 nt, Mycobacterium avium subsp. paratuberculosis
cgcggcgaaaaugcuuggggguucucagcggucgguccaccccgggcgaggacaccucgagcacguagug

SEQ ID NO: 57032 - RNA, 72 nt, Mycobacterium avium subsp. paratuberculosis
cgcuacgccgacagguucgacgugcccgcggccggccccggugggcugucggugaccuggcuggggguggcg

SEQ ID NO: 57033 - RNA, 63 nt, Mycobacterium avium subsp. paratuberculosis
cgcucgccgugcucgacgacgucgcgguggaucaguuccaugaguacaagugaguaccgagcg

SEQ ID NO: 57034 - RNA, 103 nt, Mycobacterium avium subsp. paratuberculosis
cgccgcgucguggcgguugccggugguguucgucgugcagaauguccgcggcggcccggaugcccggcggugcgccuaccgguccgagacgaugcccauggcg

SEQ ID NO: 57035 - RNA, 84 nt, Mycobacterium avium subsp. paratuberculosis
cgccguucccgcccggcgucacgcuggcgugacgcucggcggcgccggucacgccagcgugacgcucggcagccgagggcggcg

SEQ ID NO: 57036 - RNA, 86 nt, Mycobacterium avium subsp. paratuberculosis
cgccguuguccaggccgugccgcugccggacgaacgagagcgccucggacgcauccagccgcuggcgcccggccgggaagucggcg

SEQ ID NO: 57037 - RNA, 69 nt, Mycobacterium avium subsp. paratuberculosis
cgcgaugauccggcugccgucggcgaccucgcgggccagcaggucaccgaagagguugccgccguggcg

SEQ ID NO: 57038 - RNA, 105 nt, Mycobacterium avium subsp. paratuberculosis
cgcgauuacgaccugagcucgcugcgcuucgcggugaccggcgcggccaccguacccgucgugcuggucgagcggaugcaguccgagcucgacaucgacaucgug

SEQ ID NO: 57039 - RNA, 98 nt, Mycobacterium avium subsp. paratuberculosis
cgcgcaaccccacccgcaucccgugccaggccgcgauccgacccaccacgaaaagaccgagaugccgggcguuuucgggaugcgggucgggguucgcg

SEQ ID NO: 57040 - RNA, 110 nt, Mycobacterium avium subsp. paratuberculosis
cgaucaggacgacgacggagaccacccaggcgaucagcaucgcgggccggcgauaccagggggugggcucagccugcuggucgaacgggucgacguugccggguugcucg

SEQ ID NO: 57041 - RNA, 106 nt, Mycobacterium avium subsp. paratuberculosis
cgaggaguugcgcggcgcggccggcgccuccugcggagucuccuccggcagcggcggcagcacccgcagcaggucguugaacuggcgcacggugcgcagccccucg

SEQ ID NO: 57042 - RNA, 63 nt, Mycobacterium avium subsp. paratuberculosis
cgauucagcccgccgaguucuccaagaucuugcugcugaucuucuucuccgcggugcugaucg

SEQ ID NO: 57043 - RNA, 72 nt, Mycobacterium avium subsp. paratuberculosis
cgcagacggaugcggcgccgagacgcggcgugaccccaccgugucgccaccggcuccgcaucgguacaagcg

SEQ ID NO: 57044 - RNA, 61 nt, Mycobacterium avium subsp. paratuberculosis
cgcagcauugcguccgccuaacgucgagaucgaccgacagaaaggcgugaucgcgauggcg

SEQ ID NO: 57045 - RNA, 75 nt, Mycobacterium avium subsp. paratuberculosis
cgauggccucgguccagccgucgaauugugcccgaucuuccucgggcacaccgagauagugggcgacgaccaucg

SEQ ID NO: 57046 - RNA, 74 nt, Mycobacterium avium subsp. paratuberculosis
cgaugccaucgggucgcgcccgcuggacaugcaucaggccggccugcgccagcugggcgccaccugcaacaucg

SEQ ID NO: 57047 - RNA, 65 nt, Mycobacterium avium subsp. paratuberculosis
cgaugccgaccacguaccggcccagccgcuugcagcgcugggccaacggaauguagucggagucg

SEQ ID NO: 57048 - RNA, 85 nt, Mycobacterium avium subsp. paratuberculosis
cgcccacgccaggccgucggccaccgacaccucgaacaacgacgacccguaguuguuuuuggccggauggccgugcuugcgggcg

SEQ ID NO: 57049 - RNA, 57 nt, Mycobacterium avium subsp. paratuberculosis
cgcaggcugcccggcugcugcccaaccuggugacggugcugggcuggcgguccugcg

SEQ ID NO: 57050 - RNA, 55 nt, Mycobacterium avium subsp. paratuberculosis
cgccacccccgagcaggcggcgauggugcugccgcccgaggucccggguguggcg

SEQ ID NO: 57051 - RNA, 104 nt, Mycobacterium avium subsp. paratuberculosis
cgccgacccggcgguccuccucgugggugugcugccagucggugacgccggugacggccgaacccaggcuggccaggaugcccaccccgagcgcgcggguggcg

SEQ ID NO: 57052 - RNA, 56 nt, Mycobacterium avium subsp. paratuberculosis
cgcccagcccgaacuaucggcugugggacaaccgcagcaacagguucggcugggcg

SEQ ID NO: 57053 - RNA, 57 nt, Mycobacterium avium subsp. paratuberculosis
cgccccaccgauugcucgaaaucccaagcgggauauggguguugaucguuggcggcg

SEQ ID NO: 57054 - RNA, 73 nt, Mycobacterium avium subsp. paratuberculosis
cgcccgcaucucgggcgcgauguaggcgaacuccacgaacggaacucccgccugcggcgccgagacauaggcg

SEQ ID NO: 57055 - RNA, 62 nt, Mycobacterium avium subsp. paratuberculosis
cgagccgggcgugcucguuggcgucgagcaggucgaccgccgacaggcggcgcugcggaucg

SEQ ID NO: 57056 - RNA, 85 nt, Mycobacterium avium subsp. paratuberculosis
cgagcggacgcugaucaucgccgacgagggcuccuacgugcacuacguggagggcugcacggcgccgaucuacaaguccgacucg

SEQ ID NO: 57057 - RNA, 88 nt, Mycobacterium avium subsp. paratuberculosis
cgaccggcucgaaggcgucaucacgguggagaucgcggcggacaagaucaccaauuucuacgugaugcgcaacccgcacaagcuggcg

SEQ ID NO: 57058 - RNA, 76 nt, Mycobacterium avium subsp. paratuberculosis
cgagaugcuguccaucgccgacguggagaucgacgugccggcgcacaaggucacccgcaacggcgagcagaucucg

SEQ ID NO: 57059 - RNA, 103 nt, Mycobacterium avium subsp. paratuberculosis
cgagcagcggcggcuggccgaggccggccacaccguccgggucuacguacccuucggcacccagugguacggcuacuucaugcgccggcucgccgaacgcccg

SEQ ID NO: 57060 - RNA, 74 nt, Mycobacterium avium subsp. paratuberculosis
cgacgggacgcagcacaccgcgguguucaacggcgaccagugcguggacaacgccguggugcgcuauuucgucg

SEQ ID NO: 57061 - RNA, 57 nt, Mycobacterium avium subsp. paratuberculosis
ccuugugaccgcgcuguacguccguauagacuggacgaucguauagcaggugcaggg

SEQ ID NO: 57062 - RNA, 68 nt, Mycobacterium avium subsp. paratuberculosis
ccuugugcuggcgcaguuuucggccgaagccgcuguccuggcccaagcugccgcccagaugcaccugg

SEQ ID NO: 57063 - RNA, 70 nt, Mycobacterium avium subsp. paratuberculosis
ccuugaaguccuggugcguccaagcggagugcaucucgaagguccgguccgcgcgcuccaggaaguaggg

SEQ ID NO: 57064 - RNA, 59 nt, Mycobacterium avium subsp. paratuberculosis
ccuugagcaccgguccggcguugacggcgaucggguggccgggcucguggcgcuccggg

SEQ ID NO: 57065 - RNA, 70 nt, Mycobacterium avium subsp. paratuberculosis
cgaagacguucugguccuucauccggugcgccagccauuggucgcccugggucuggaucagcgcguagcg

SEQ ID NO: 57066 - RNA, 89 nt, Mycobacterium avium subsp. paratuberculosis
cgaacaccggcucgucgggauuggguugcauguuccggucgaccgcgagcagcaugccgucgcggcgaaacaccuugcgccggugggcg

SEQ ID NO: 57067 - RNA, 60 nt, Mycobacterium avium subsp. paratuberculosis
ccuccuggccgcccagggcguggcugaacacggccgaaccguccggcuggcgccaggugg

SEQ ID NO: 57068 - RNA, 68 nt, Mycobacterium avium subsp. paratuberculosis
ccucccaggccuggucaucgagcuggcggucgcgcaccaggcccagcuccuuggcccggucguugagg

SEQ ID NO: 57069 - RNA, 68 nt, Mycobacterium avium subsp. paratuberculosis
ccgguacgaggacauccgggcgcugaccuacaugaacggcuucaggcuggaagugcucggcuugccgg

SEQ ID NO: 57070 - RNA, 76 nt, Mycobacterium avium subsp. paratuberculosis
ccgguugagguauuccuguucgagaauuucacggaacuuuucuaugccccaguccuugaccaggaacuucagccgg

SEQ ID NO: 57071 - RNA, 69 nt, Mycobacterium avium subsp. paratuberculosis
ccggugugcgccaccaagauaucgggcgguugggcgaucaccgccucgguguggcggugcagcuccugg

SEQ ID NO: 57072 - RNA, 98 nt, Mycobacterium avium subsp. paratuberculosis
ccguccagcaccaagaccacggucaccgguguggagauguuccgcaagcugcucgaccagggccaggccggugacaacgucggucugcugcugcgugg

SEQ ID NO: 57073 - RNA, 82 nt, Mycobacterium avium subsp. paratuberculosis
ccguccgucaggacucgcccggcgcccugcugcgcggccggguggagcggaugcaccgggcguguuugauccugaccuucgg

SEQ ID NO: 57074 - RNA, 56 nt, Mycobacterium avium subsp. paratuberculosis
ccugggcgagcccaccggcggcuacaucgaggccggcugccagggcacgcugcggg

SEQ ID NO: 57075 - RNA, 120 nt, Mycobacterium avium subsp. paratuberculosis
ccuggcccucggaugcgucgaaccagaugggugggcucaccaggacgucgcgcagcgucaugccgcguucgcgcgcgccgggggcguacucggccagauagguaucgacgaaucgccggg

SEQ ID NO: 57076 - RNA, 71 nt, Mycobacterium avium subsp. paratuberculosis
ccgcuucgacacgguguugauagcgugguuuucaugacugaacaccuugacguccucaucgugggcgccgg

SEQ ID NO: 57077 - RNA, 104 nt, Mycobacterium avium subsp. paratuberculosis
ccgcgacggcgucucgccgcaggcaugggcggugguccucaaugcgccgcagcgucccagcugcggccguagcccacggacaccuccagcgggacgucgagcgg

SEQ ID NO: 57078 - RNA, 58 nt, Mycobacterium avium subsp. paratuberculosis
ccgcgcacgcgaucaucgagguucugcucgcggagccggccgagguugcgcugcgcgg

SEQ ID NO: 57079 - RNA, 70 nt, Mycobacterium avium subsp. paratuberculosis
ccgcgccgaacgugaagcuaguuucacguucgcggucgagcgugaaacuagcuucacgcucggcaggcgg

SEQ ID NO: 57080 - RNA, 57 nt, Mycobacterium avium subsp. paratuberculosis
ccgggagaacgcggccgcggcguugcgguccggcggcguggugaucguguuccccgg

SEQ ID NO: 57081 - RNA, 81 nt, Mycobacterium avium subsp. paratuberculosis
ccgggauccuguccggcagccuguaucaccacuucuccuccaaggaggagauggucgacgaggugcugcgcagcuuccugg

SEQ ID NO: 57082 - RNA, 86 nt, Mycobacterium avium subsp. paratuberculosis
ccggcgcagguacaggugcaggucguguucccaggugacgccgauaccgccgugcaucugcacgcaggccugcacgaucugcccgg

SEQ ID NO: 57083 - RNA, 69 nt, Mycobacterium avium subsp. paratuberculosis
ccggcgcccagcagcgagaugacccggugcagcgcucgcugcgccccguuacgcguugggaauugccgg

SEQ ID NO: 57084 - RNA, 78 nt, Mycobacterium avium subsp. paratuberculosis
ccggcggcucugcugcgcugccuggucgagggcgccgacgaggugcacgucgaucccggcaucgcggcugccggccgg

SEQ ID NO: 57085 - RNA, 61 nt, Mycobacterium avium subsp. paratuberculosis
ccggcgucgacguccucgucgguggccgccaguccguccaguucgacggcgucgacgccgg

SEQ ID NO: 57086 - RNA, 76 nt, Mycobacterium avium subsp. paratuberculosis
ccggcucacgccgucggugcugggccaguugaucgcgcucuacgaacaccaggucuucaccgagggcgugaucugg

SEQ ID NO: 57087 - RNA, 73 nt, Mycobacterium avium subsp. paratuberculosis
ccggggaccugacgucggcgcugcuggaggccgagaucgacggcgaucggcucaccgacgacgaggugcucgg

SEQ ID NO: 57088 - RNA, 128 nt, Mycobacterium avium subsp. paratuberculosis
ccgggccgcugcuguucgacccgcugcgcgaaaggcuggcccacuacgccgggcuggacuuccuguccgggcugacgguggugccgggggaacucggcggcaaugccgggcugaucggcgcggcccgg

SEQ ID NO: 57089 - RNA, 65 nt, Mycobacterium avium subsp. paratuberculosis
cccuuuuugucccaaggcuguucgugggcgucgggguuggccuugauccacgccuuggcggcggg

SEQ ID NO: 57090 - RNA, 69 nt, Mycobacterium avium subsp. paratuberculosis
ccgaaacguucucaccaugcacccagaucucgccgaccguucccggugggcacucagugcugguuucgg

SEQ ID NO: 57091 - RNA, 60 nt, Mycobacterium avium subsp. paratuberculosis
cccgcgcagcgucgcggaccgguauucggugcggaacaggccgcggcguugcaacucggg

SEQ ID NO: 57092 - RNA, 56 nt, Mycobacterium avium subsp. paratuberculosis
cccgacgcgguguacgucucgcucgaggacgagcucagcgaccacacgguguccgg

SEQ ID NO: 57093 - RNA, 72 nt, Mycobacterium avium subsp. paratuberculosis
cccgggccagccgggcgacggucugcucgacgaaaacgucucgcggccggcaagucagcccggcggcacggg

SEQ ID NO: 57094 - RNA, 106 nt, Mycobacterium avium subsp. paratuberculosis
ccgaggcauucccgcgccgaaacgcugaccugcgaccaggaccgguccggcacgcugggcuugaggucgucgcggucaccggagucggugcucgacgcccauucgg

SEQ ID NO: 57095 - RNA, 88 nt, Mycobacterium avium subsp. paratuberculosis
ccgaggcgguggccgccgcgcgugcgcaccggcgcagcuucgucgccgaccggcuggccaccggcaccgcggcgcuguucgcguucgg

SEQ ID NO: 57096 - RNA, 92 nt, Mycobacterium avium subsp. paratuberculosis
ccgacauagaaaugucacccaucaaccgacucugaacaggggcacuuugucuguuguaugaccucgguugaugcuugacguuucggcuucgg

SEQ ID NO: 57097 - RNA, 67 nt, Mycobacterium avium subsp. paratuberculosis
ccgagccgcaacguuugauuuugugucugagacaagaccacaggugaucaucgaugcggccgcacgg

SEQ ID NO: 57098 - RNA, 70 nt, Mycobacterium avium subsp. paratuberculosis
ccgccgccgccagcaccgcgcugugcguggcgcugggggugccgauggcgcuggugcuggcgcgcggcgg

SEQ ID NO: 57099 - RNA, 76 nt, Mycobacterium avium subsp. paratuberculosis
ccgcccgauccugcgccucggugguggacgcacccagaugcggcgugaccaccaccugcggcagcucgaacagcgg

SEQ ID NO: 57100 - RNA, 81 nt, Mycobacterium avium subsp. paratuberculosis
ccgcccugcgccgcgccgugccggccaccaagggcaacacccgccggcuggccacgcucggcccgcugcugcaggaccugg

SEQ ID NO: 57101 - RNA, 94 nt, Mycobacterium avium subsp. paratuberculosis
ccgacccgugcgacgggugauagaucugguugauguuggccgcggccgucggcagcacgugcagcgcggucuccagcccguucagcggguccgg

SEQ ID NO: 57102 - RNA, 64 nt, Mycobacterium avium subsp. paratuberculosis
ccgacguugcgcagggcguccacccagggccggacgaccucggcgcugcccggcgcgauguugg

SEQ ID NO: 57103 - RNA, 130 nt, Mycobacterium avium subsp. paratuberculosis
ccgcaucccggacgccgaguuggugaucgugggcgggccgccggcggccgaacuggccggcgacgagcaggcgcggcggcugcaacgacugaccggcgagcucggcgucgccgaccgggugcggcugcug

SEQ ID NO: 57104 - RNA, 65 nt, Mycobacterium avium subsp. paratuberculosis
cguggucauccaggcgguguucggcuucagccugcucgaggcggucaacuaccuggagcacuacg

SEQ ID NO: 57105 - RNA, 130 nt, Mycobacterium avium subsp. paratuberculosis
cguugccggucaugaaggucacgaaguagccggcggagugcgugaaggcgguggcucccagcaccccggccagcaccgccagcacccacgacaaccugguuucgcuguuguugaucucacucggcacacg

SEQ ID NO: 57106 - RNA, 103 nt, Mycobacterium avium subsp. paratuberculosis
cgugcaaugggugagacugcccaccacgccgucgggccagcgggguucucccuucucgcccuugaggaucggcgccgggggcaggccgagcucgcccagcgcg

SEQ ID NO: 57107 - RNA, 59 nt, Mycobacterium avium subsp. paratuberculosis
cgugccccgcgacaagccaggcuagucucgcaaaaggcaacugcgcaccgcggggcgcg

SEQ ID NO: 57108 - RNA, 98 nt, Mycobacterium avium subsp. paratuberculosis
cgucggugaagaugaggucggccagguuguuguuggugcggcgcaaccggcgggccagcacccgcaacagcuguucggcgaucucggggcggucggcg

SEQ ID NO: 57109 - RNA, 83 nt, Mycobacterium avium subsp. paratuberculosis
cgucguagaugucggacgccuugccgaagucgcuccacuuguucggggugaggguggcguacagggugccgucgacgacgacg

SEQ ID NO: 57110 - RNA, 115 nt, Mycobacterium avium subsp. paratuberculosis
cgucugccaguucaccauggucaaguaagccggccagcgucgaguuguugggccgaaaaacggcuuaaucgcccaacaacucgacguucggcgggcaggccgaagaacucagccg

SEQ ID NO: 57111 - RNA, 71 nt, Mycobacterium avium subsp. paratuberculosis
cgugcgggccaaccggcuggcccggcugcucgacgacgacgcgccgcugggccgggcgguggcgccggacg

SEQ ID NO: 57112 - RNA, 116 nt, Mycobacterium avium subsp. paratuberculosis
cgucaaacacugcacgugauugccucgcgggaccgcaggcugcucaaaacggcacggguauugccugccaccggucucgaacucaugagggcgacacucagugaccaauuuugacg

SEQ ID NO: 57113 - RNA, 123 nt, Mycobacterium avium subsp. paratuberculosis
cggugggccggucgguuugggcgccggcgugcaccugcuggaucacggcgucgaaauaggugucauauugccgggcccgcgcgggugccgccccgccgagcaccugggccaccagguucaccg

SEQ ID NO: 57114 - RNA, 60 nt, Mycobacterium avium subsp. paratuberculosis
cggugguggcggcgcuggcgcacacgcccccgguguacgaauucgccgucgccaaugccg

SEQ ID NO: 57115 - RNA, 107 nt, Mycobacterium avium subsp. paratuberculosis
cguccuccaugguggugcggcgcaucccgacgaguucggccuguucgaggguggcggccagaauucgggcggugaucucgucgggguugucgaccugggcgaggacg

SEQ ID NO: 57116 - RNA, 90 nt, Mycobacterium avium subsp. paratuberculosis
cgucccacggugcggccgacaaggcaugcggcaguuggaaucccacgacauugcucagcagcuuguucagguagccgcuccaguucaccg

SEQ ID NO: 57117 - RNA, 89 nt, Mycobacterium avium subsp. paratuberculosis
cgucgccgggucggagcuggcgcugauguaggccgccagguagucgcgcuugaaccgguucaucgcgcuggucagcugauacgacgacg

SEQ ID NO: 57118 - RNA, 120 nt, Mycobacterium avium subsp. paratuberculosis
cucggcgcggucaccgggguggggcacgcgcggcugaucaacgagcgcuucggccggggcuggggcugguucucggucggcgaccuguucuugcucaauuucuugaccaucgucaccgag

SEQ ID NO: 57119 - RNA, 62 nt, Mycobacterium avium subsp. paratuberculosis
cuacgugggauaugcgacgggagccagcuggccguugcuggacgcgggccugucccacgugg

SEQ ID NO: 57120 - RNA, 68 nt, Mycobacterium avium subsp. paratuberculosis
cguugugggcuuggcgcagcgccgcauagacgucgacguugugcggugcgaugccgggcagaugcacg

SEQ ID NO: 57121 - RNA, 64 nt, Mycobacterium avium subsp. paratuberculosis
cugguugggggcgcugggauuugccgcccuggcggucuauuggcucuaucgcuucgucggccag

SEQ ID NO: 57122 - RNA, 78 nt, Mycobacterium avium subsp. paratuberculosis
cugcgcaccggcggcucguacuagagggccuucgcgaucagccgaagggucuaguugaacgagucgccgcaggcgcag

SEQ ID NO: 57123 - RNA, 76 nt, Mycobacterium avium subsp. paratuberculosis
cugcccuggugaaucggcccauagcggacacacuagaacguguucucccguuuuucgggucaguucaucgggucgg

SEQ ID NO: 57124 - RNA, 74 nt, Mycobacterium avium subsp. paratuberculosis
cugcuggcgcaccagggugccgccuccaggucgcgcgcugacgugauggguggcggcgacccgcgcgccggggg

SEQ ID NO: 57125 - RNA, 68 nt, Mycobacterium avium subsp. paratuberculosis
cucugaccagcauccgacgcgccggagccgauaucguucugagcuauugggccgcggaugcggcaggg

SEQ ID NO: 57126 - RNA, 56 nt, Mycobacterium avium subsp. paratuberculosis
gagaaccaguccucgggcgucauccccaucaugaagcugcuggaggacucguucuc

SEQ ID NO: 57127 - RNA, 129 nt, Mycobacterium avium subsp. paratuberculosis
gacgacgggcgcgucggccagcgucucuucgaucgcugcggucaggccacugcucggcccgaccuccaggaaacgggucgcaccggccgacugcgcgaaccgcacgcugucggcgaagcgcaccgcguc

SEQ ID NO: 57128 - RNA, 69 nt, Mycobacterium avium subsp. paratuberculosis
gacggcccggucguucuuccccaacguggugaccacccacaccugggaagagcgcugggacaccuuguc

SEQ ID NO: 57129 - RNA, 62 nt, Mycobacterium avium subsp. paratuberculosis
gacggcgaugaggaucugucucaucggcgggucccgccggcugagucgcccucgcgaucguc

SEQ ID NO: 57130 - RNA, 71 nt, Mycobacterium avium subsp. paratuberculosis
gaccaagcuggugcccgggccgcugacgcccaaggacucgcacuggcgccacgcccgggcaccuggugguu

SEQ ID NO: 57131 - RNA, 116 nt, Mycobacterium avium subsp. paratuberculosis
gaccaccaaugcccgguagccgggcgggaugguggccagcacccccggcagcgacuccucuucguugaggcagggcaggaccaccgugacccgaccgucggugccgggcacggguc

SEQ ID NO: 57132 - RNA, 77 nt, Mycobacterium avium subsp. paratuberculosis
gacccggcggcgcucggcgcgccgccgcgcccgccgguguucguguuggugguggucgcgcugacgcucgccggguu

SEQ ID NO: 57133 - RNA, 61 nt, Mycobacterium avium subsp. paratuberculosis
gacccggcugccggaccaccucaucgucaucgacaacgaugcgugcgacgacggccggguc

SEQ ID NO: 57134 - RNA, 108 nt, Mycobacterium avium subsp. paratuberculosis
gaccgcggcggccacggccugggcggcguugccgcgguucaccgcgcccgguagcgccaaccgcaucggcagcgccacaccgccggggccguacagguugccgccguc

SEQ ID NO: 57135 - RNA, 63 nt, Mycobacterium avium subsp. paratuberculosis
gaccgcgucaccgccggcguggaccggcugggcuaccggcugauccggcugagcgggcagguc

SEQ ID NO: 57136 - RNA, 60 nt, Mycobacterium avium subsp. paratuberculosis
gacgaauuccuggacauggucaccggguggacccgcacccgcaccacccaggagaucguc

SEQ ID NO: 57137 - RNA, 86 nt, Mycobacterium avium subsp. paratuberculosis
gaagccggugggaacggugugcuucagcgugcaggucggcccacccggugccacggcccgcucggacacccgcaccaugcggcuuc

SEQ ID NO: 57138 - RNA, 56 nt, Mycobacterium avium subsp. paratuberculosis
gaagcgcugcgccgcuuacccguugcggcccggccgguuugcggugcagcacuguc

SEQ ID NO: 57139 - RNA, 82 nt, Mycobacterium avium subsp. paratuberculosis
gaagggcaccagcgcguugaccgagccaccggucgcgaccagcaacgccaccgacaacgcggucagggugaugaugccguuc

SEQ ID NO: 57140 - RNA, 67 nt, Mycobacterium avium subsp. paratuberculosis
gaaggugucggggucggcgguggcgugguagugcuuggcgcccagccgcagcccguccuccaucuuc

SEQ ID NO: 57141 - RNA, 56 nt, Mycobacterium avium subsp. paratuberculosis
gaaccccgccgauuuccuggugcugcaucgacuugccaagggaguauucgggguuc

SEQ ID NO: 57142 - RNA, 68 nt, Mycobacterium avium subsp. paratuberculosis
gaacaggugcuggccgacauggcgagaaucgacgaccacggggaugccgugcuuggccagcucgcguc

SEQ ID NO: 57143 - RNA, 71 nt, Mycobacterium avium subsp. paratuberculosis
aaggugcgggccagcuggugccacugguaguugguccacgaguccagcaggucgcgguuggccagcagcuu

SEQ ID NO: 57144 - RNA, 89 nt, Mycobacterium avium subsp. paratuberculosis
aacgacaaggacaucaagcaguacgcgaugucggaucugcugaucgcggcgaucgcggcguucgugcugaucuucuugaucauguuguu

SEQ ID NO: 57145 - RNA, 65 nt, Mycobacterium avium subsp. paratuberculosis
accuugacggcgugcccgacguugcccgcguucaucgcgaagguggcgcugagcgcguccagggu

SEQ ID NO: 57146 - RNA, 128 nt, Mycobacterium avium subsp. paratuberculosis
acggugcgcacgcuccaccgguuggccggcgcgcagaucuccucgacgacgucggugaugauuucgaucagcccggccagcucgucggggucgcgcugcagguucuccguggaaagcagguacaccgu

SEQ ID NO: 57147 - RNA, 64 nt, Mycobacterium avium subsp. paratuberculosis
acgccccggccgaacccggacgugcgaagacagucaucugcucucacuccucguucaccugugu

SEQ ID NO: 57148 - RNA, 67 nt, Mycobacterium avium subsp. paratuberculosis
accugggccagaugcucgacuuccacgccgcgcagcaggccgacgucacccugcaccugguccgggu

SEQ ID NO: 57149 - RNA, 56 nt, Mycobacterium avium subsp. paratuberculosis
accugggcgcgccggucgagccgcgcauccccgcgcugagcggccaacccccgggu

SEQ ID NO: 57150 - RNA, 55 nt, Mycobacterium avium subsp. paratuberculosis
accuccagcacccgggucagcgcguccauuuugcgcgggccggcgaccuggaugu

SEQ ID NO: 57151 - RNA, 85 nt, Mycobacterium avium subsp. paratuberculosis
accgcucgaacuccucguaggccaccgcgcacucgcccgcccgcagcugcaggguggccagcgacaccuugaguuccagggcggu

SEQ ID NO: 57152 - RNA, 59 nt, Mycobacterium avium subsp. paratuberculosis
accauggccgcccgggugguguggcugaucgccaacggcuacgcccaccccggccaggu

SEQ ID NO: 57153 - RNA, 61 nt, Mycobacterium avium subsp. paratuberculosis
accacgaggaccagcgucgcgaacccgaucagaaaccaguucucgauguggccgacguggu

SEQ ID NO: 57154 - RNA, 55 nt, Mycobacterium avium subsp. paratuberculosis
accagcagcgcgucacgcugagcuccuaccgcggcuccaagaacgugcugcuggu

SEQ ID NO: 57155 - RNA, 117 nt, Mycobacterium avium subsp. paratuberculosis
acagcgccggguccaggaugucgggccgguugguggcggcgaucaggaucacgccggcccgcgggucgaacccguccaucucgaccagcaacugguucagcgucugcucgcgcucgu

SEQ ID NO: 57156 - RNA, 65 nt, Mycobacterium avium subsp. paratuberculosis
aggcggccguggaggagggcaucgucgccggcgguggcguggcccugcugcacgcgaucccggcu

SEQ ID NO: 57157 - RNA, 81 nt, Mycobacterium avium subsp. paratuberculosis
aggcaggcccaugcucagcacgauucgcaaaguccuggacuaucaguugaccaucgccgaacugcugggccugggcauccu

SEQ ID NO: 57158 - RNA, 57 nt, Mycobacterium avium subsp. paratuberculosis
aggggcugcacgucggccacccgcugggcuacaucgccaccgacguguacgcccgcu

SEQ ID NO: 57159 - RNA, 71 nt, Mycobacterium avium subsp. paratuberculosis
agggccaucgcgauguuccucucgguagugauccuuggucguuucaccacagagacucacgcgauggcccu

SEQ ID NO: 57160 - RNA, 71 nt, Mycobacterium avium subsp. paratuberculosis
agggccaucgcgugagucucuguggugaaacgaccaaggaucacuaccgagaggaacaucgcgauggcccu

SEQ ID NO: 57161 - RNA, 103 nt, Mycobacterium avium subsp. paratuberculosis
aggucgccguccgggaccggaucggcccgcucgaugcgucggcgcgcccggcuggccagcuugcgggccgacuccggcgugccguccacgaucgcggcgaucu

SEQ ID NO: 57162 - RNA, 73 nt, Mycobacterium avium subsp. paratuberculosis
aggucacccugggcgaguuggugaucgacgagggcaccuauaccgcccgguugcgcggccgcccgcuugaccu

SEQ ID NO: 57163 - RNA, 88 nt, Mycobacterium avium subsp. paratuberculosis
aggugacgagcccgaccagacccagcagcaccgacgcgacgccgaacucguuacgcggcggcugcgggucacucaucgccucucaccu

SEQ ID NO: 57164 - RNA, 72 nt, Mycobacterium avium subsp. paratuberculosis
agguggucaaggacuacgucgcguucccggcgcugacgucacugucgcccggcgcgaccuuccuguccaccu

SEQ ID NO: 57165 - RNA, 90 nt, Mycobacterium avium subsp. paratuberculosis
aggugucgccgaucgacagcuugucgccgacgugcgcgucgcagaugaugcgccgcgccagcagcccggcgaccuggaccgcgaccaccu

SEQ ID NO: 57166 - RNA, 67 nt, Mycobacterium avium subsp. paratuberculosis
agcagguggugcgcugcagcgaccgguccggcuucguggucaacgcgcugcuggugcccuaccugcu

SEQ ID NO: 57167 - RNA, 79 nt, Mycobacterium avium subsp. paratuberculosis
agccgcaaguuuuucugcauucgaaaguacuauuucaggauuucugaaguaucuagaugaauucagugagaauucgguu

SEQ ID NO: 57168 - RNA, 130 nt, Mycobacterium avium subsp. paratuberculosis
aggacgcccucgucgucgcgcagcccgccgaacccggacaccagcgccguccacgcgccggccagcgaggccaugugcaggccgucgcggguguuguggugcaggucgcgcaggucgaucagggcggccu

SEQ ID NO: 57169 - RNA, 83 nt, Mycobacterium avium subsp. paratuberculosis
agcuucuugcgauugcggcuggcgaccagcagcgggcucaacaguuaucccugaacaugcgucggcugcacuugcacgacucu

SEQ ID NO: 57170 - RNA, 65 nt, Mycobacterium avium subsp. paratuberculosis
agcugggcgacuuucgcggaguucuggaaccugauccacggauccaucugcaggguggcccaguu

SEQ ID NO: 57171 - RNA, 89 nt, Mycobacterium avium subsp. paratuberculosis
acugauguagagggccaucgcgugagucucuguggugaaacgaccaaggaucacuaccgagaggaacaucgcgauggcccuggaccagu

SEQ ID NO: 57172 - RNA, 86 nt, Mycobacterium avium subsp. paratuberculosis
acucagugucuuuggucgcggugcgcaggaaugccgucaccggcgacguguagcgcagcauuucuucgaucgcggucggcaugagu

SEQ ID NO: 57173 - RNA, 121 nt, Mycobacterium avium subsp. paratuberculosis
acugcugcggggacagcuagaucgugggaggcagaugugguugugagcguuaggggacacagcgucccccacuuccauuucccuugcccgcgauguggguaugcgacccgcuacaagcagu

SEQ ID NO: 57174 - RNA, 91 nt, Mycobacterium avium subsp. paratuberculosis
agcaccgggugaaucuggcggggucgacggcagagcggaucucggugcccuacuucuucaauccgcgccucgacgcccggauacccgugcu

SEQ ID NO: 57175 - RNA, 129 nt, Mycobacterium avium subsp. paratuberculosis
caccgaacggcuggcccaggaucucgacgggcugaccugcgcggcccggccacugaccgccgaggagaucgccgagguggaccgggcggugcuggccgaccuggaaccgaccuggagccgccccgggug

SEQ ID NO: 57176 - RNA, 61 nt, Mycobacterium avium subsp. paratuberculosis
caccgaccugcucgacggguggguggccuacuucgccgaccacccgcacgagcgggcgcug

SEQ ID NO: 57177 - RNA, 55 nt, Mycobacterium avium subsp. paratuberculosis
caccagcaggauugggacgucgggccagaugcugacgugccagcgcgcgcuggug

SEQ ID NO: 57178 - RNA, 55 nt, Mycobacterium avium subsp. paratuberculosis
caccagcgcgcgcuggcacgucagcaucuggcccgacgucccaauccugcuggug

SEQ ID NO: 57179 - RNA, 84 nt, Mycobacterium avium subsp. paratuberculosis
caccguggcguugcggccgccguacuccggcggcuggcugggcagcagccagccguugucgaacagcagccguugccagcggcg

SEQ ID NO: 57180 - RNA, 76 nt, Mycobacterium avium subsp. paratuberculosis
cacgaugugaugggucugcgccucgaucagcgcgaaauacgacgagccgacguaaccguacggcccgaacaccgug

SEQ ID NO: 57181 - RNA, 57 nt, Mycobacterium avium subsp. paratuberculosis
cacgcacccgccgaucgaggaccggauccgccgccuggaauccauggcggggcgcug

SEQ ID NO: 57182 - RNA, 96 nt, Mycobacterium avium subsp. paratuberculosis
cagauacucgccgcuguccugaucgcgcaucagcugcccgcgcagauagcccuugcgcccggccaccgacgugaugggcgacagcgugcgggccug

SEQ ID NO: 57183 - RNA, 58 nt, Mycobacterium avium subsp. paratuberculosis
caacgcugcgaucugccccgccgcgguuuuuugcgccucggccaggcucgcggcgaug

SEQ ID NO: 57184 - RNA, 79 nt, Mycobacterium avium subsp. paratuberculosis
caacugcgguuuuuugcgcgcguaccggaucuaguggcacacucauuuggugcucaccgugcaguguuaccggcgguug

SEQ ID NO: 57185 - RNA, 78 nt, Mycobacterium avium subsp. paratuberculosis
aucgcaccugggguucaucuccgcggcgucgaagugccuggcguccgacgucgcgauggaggugaccacggacgcggu

SEQ ID NO: 57186 - RNA, 73 nt, Mycobacterium avium subsp. paratuberculosis
auccggccgcagcguguucagcccgguggucuucagccacugccgaccccagucggacaggucgcggccggau

SEQ ID NO: 57187 - RNA, 58 nt, Mycobacterium avium subsp. paratuberculosis
aucaggucggugcggugcuuggggaacagcaccccgcgcgacaccucgccgaccuggu

SEQ ID NO: 57188 - RNA, 57 nt, Mycobacterium avium subsp. paratuberculosis
auggcagcggauccucgacaucaaccugaccggaguguuucugggcauccgcgccgu

SEQ ID NO: 57189 - RNA, 78 nt, Mycobacterium avium subsp. paratuberculosis
auggacgcuggugauggcggcgaccaccaucgcgaucgucccgcuggucacgcuguucgucaucuuccagcgucacau

SEQ ID NO: 57190 - RNA, 86 nt, Mycobacterium avium subsp. paratuberculosis
auggugggcucccaccgggccagcgccuuggacuugaacgccgccgacaccagguugcgguggucccggugcuucuugcccuccau

SEQ ID NO: 57191 - RNA, 129 nt, Mycobacterium avium subsp. paratuberculosis
cccgaagaucaccgucugcggguugagccgccgggcggagucggcgcgcugcagcgcaucgaaugccgacggcguuuggcugagcacgucgacccguuccucgaucagcaaggcgcacaggucuuccgg

SEQ ID NO: 57192 - RNA, 62 nt, Mycobacterium avium subsp. paratuberculosis
ccacgcacugaccgggcugcaggucgauccacuucucgcugugcgagcccggcgguagcggg

SEQ ID NO: 57193 - RNA, 76 nt, Mycobacterium avium subsp. paratuberculosis
cccaggcgguugccgagucguggucggugacccgguggucgcugggcggcagcucggcauagcccaauccccuggg

SEQ ID NO: 57194 - RNA, 59 nt, Mycobacterium avium subsp. paratuberculosis
ccauugccgcgccgcgacgauguuggucaccaggaucagcgucgucgcgccggcuuugg

SEQ ID NO: 57195 - RNA, 62 nt, Mycobacterium avium subsp. paratuberculosis
ccauuguggccggugucucaugucguaugaguacuaucugacacauggcgacggcccgaagg

SEQ ID NO: 57196 - RNA, 90 nt, Mycobacterium avium subsp. paratuberculosis
cccaacccgaaugccgacccgcuucgguggcguggaugguggaaaccauuggcacgucguagaauugggcgagcgcgaucgcgggauggg

SEQ ID NO: 57197 - RNA, 58 nt, Mycobacterium avium subsp. paratuberculosis
ccagcccgagcaccggcgcggcucguucggcaaacccgcgcccggguucgaggccagg

SEQ ID NO: 57198 - RNA, 56 nt, Mycobacterium avium subsp. paratuberculosis
ccagcccuaugagcagcccggcaagaagcgccccgucgggcugaucgccggggugg

SEQ ID NO: 57199 - RNA, 56 nt, Mycobacterium avium subsp. paratuberculosis
ccagcacgcggcguccaucaucguggccaccagccgcgacgacaccgccgugcugg

SEQ ID NO: 57200 - RNA, 100 nt, Mycobacterium avium subsp. paratuberculosis
ccagccggcgcaccgccagcgcgggcugcucgggggugggcucgucgagcccgagcaccggauccaguccgcgcauguagggggccagcgccaggugcgg

SEQ ID NO: 57201 - RNA, 75 nt, Mycobacterium avium subsp. paratuberculosis
cauguaugggccgacggcggcauccggcacccgcgugacguggcgcuggcgcuggccgccggggcgucgaacgug

SEQ ID NO: 57202 - RNA, 63 nt, Mycobacterium avium subsp. paratuberculosis
ccaaauacguugggcagaaacgcuuuucgcuggaaggcgcggaaagugugaucccgaugaugg

SEQ ID NO: 57203 - RNA, 63 nt, Mycobacterium avium subsp. paratuberculosis
ccaagcccggccgcagccuggagcggcucaaguccgagcugcugcugcugauggcgggcgugg

SEQ ID NO: 57204 - RNA, 75 nt, Mycobacterium avium subsp. paratuberculosis
cagcaucgcgaccgugccggcgagcaggaugcccaacguguccugcgacccgucgcgcgggcgcugcgggugcug

SEQ ID NO: 57205 - RNA, 79 nt, Mycobacterium avium subsp. paratuberculosis
cagccccaagucgguggccacgaucgccgcgguggcggugaucuucgucggcggcaucguggcccuggcgugggcgcug

SEQ ID NO: 57206 - RNA, 129 nt, Mycobacterium avium subsp. paratuberculosis
cagccggucccccagauuggagccgauggauaagacaacgcgugucauuggcgccgcuccucaaccgcggcugcgccggcgucaucgucgucgucgcgugucauuggcgccgcuccucaaccccggcug

SEQ ID NO: 57207 - RNA, 122 nt, Mycobacterium avium subsp. paratuberculosis
caggacggcgucgaaauccauugcccgucuacagcaauugggugcuggcgccgccgucggcguagaugauggugccggugguggccggcagccagucggacagcagcgcgcacaccgucuug

SEQ ID NO: 57208 - RNA, 64 nt, Mycobacterium avium subsp. paratuberculosis
caggaucggcgcguucuucgaccuggacggcacccuggucgccggguucaccgcggugauccug

SEQ ID NO: 57209 - RNA, 82 nt, Mycobacterium avium subsp. paratuberculosis
caucaugggcaccgggcuggccgcggcggcgcuggccggcaacggcacgcccgaacagcugggccgcugguugcccgagaug

SEQ ID NO: 57210 - RNA, 76 nt, Mycobacterium avium subsp. paratuberculosis
caucgacuccccgauccuggggccgggcccgagcaucgcguugaugcucagccuggugcccagcgccgagccgaug

SEQ ID NO: 57211 - RNA, 73 nt, Mycobacterium avium subsp. paratuberculosis
caucgcccuggccgaccagcugauucgcgccggagaguucgacguggugguagccggcggucaggagucgaug

SEQ ID NO: 57212 - RNA, 60 nt, Mycobacterium avium subsp. paratuberculosis
caugaggugacguucgaauccgcuagcgccugcgguagcgcguucgaaagugacgucgug

SEQ ID NO: 57213 - RNA, 57 nt, Mycobacterium avium subsp. paratuberculosis
caggucuuccagaaggcggucgaauacuccgacgucgaccugaccuucuacgaccug

SEQ ID NO: 57214 - RNA, 71 nt, Mycobacterium bovis subsp bovis AF2122/97
caugcuggacacuucgguuaaucgucacuaacguagcacgagcuauucgauguuaacgcgagucagacaug

SEQ ID NO: 57215 - RNA, 110 nt, Mycobacterium bovis subsp bovis AF2122/97
caucgccgcgcgaacucgcaaagguagacgugucccgcauggggcggcaugaacuugccgagcaccauuccgugugucacgacgucgccucagcgauucggccggcgaug

SEQ ID NO: 57216 - RNA, 130 nt, Mycobacterium bovis subsp bovis AF2122/97
caucgccgggucgaggcgggucagcguggccagcacgcgauccauccgcgguucgcuguugguuuccacccgcagcgugucaccgucgaggaccagcguggcccggacccgcagcaugccgucguuggug

SEQ ID NO: 57217 - RNA, 56 nt, Mycobacterium bovis subsp bovis AF2122/97
cauccagcacuucuggggggauccgcugacagcggcgggaucccaaagugcggaug

SEQ ID NO: 57218 - RNA, 101 nt, Mycobacterium bovis subsp bovis AF2122/97
caucccgggcaucggcaucccgggcaucggcauccccggcguacccgacccaaucaccggggugaacaccgcugccgcggucgugaacgguguccugggug

SEQ ID NO: 57219 - RNA, 81 nt, Mycobacterium bovis subsp bovis AF2122/97
cagggaacgcagcgcggucaggucgccggucuggauggcgauguccaagcucuggauggccugccgcaccugaucuuccug

SEQ ID NO: 57220 - RNA, 87 nt, Mycobacterium bovis subsp bovis AF2122/97
cagcagggugguggugccgucgucgcgcagcccggccgcccaugagauucgcggcuccuggcgcgccacggcauccacgauucgcug

SEQ ID NO: 57221 - RNA, 56 nt, Mycobacterium bovis subsp bovis AF2122/97
caggggcucgauccggccgggccggcugcggcgcugguggaauucgagcgcuccug

SEQ ID NO: 57222 - RNA, 76 nt, Mycobacterium bovis subsp bovis AF2122/97
cagccgccgcggcagggaaaggccguggucggucuucaugauguaggccacgccgcccuugccggacugcgaguug

SEQ ID NO: 57223 - RNA, 72 nt, Mycobacterium bovis subsp bovis AF2122/97
cagcgaggucggccucccaugcggcgaucucauuguuggggcgcaggucggcguaugggaaguacccuccug

SEQ ID NO: 57224 - RNA, 115 nt, Mycobacterium bovis subsp bovis AF2122/97
cagcgcaucggaguccagaaucucucgauggcgggucaucgcacccagccgaaccagguugggauuguugauuccgccgaccacgacguagccgaguucgggggccaggucguug

SEQ ID NO: 57225 - RNA, 89 nt, Mycobacterium bovis subsp bovis AF2122/97
cagcuccgaccugauauguucaauaaaucauuauguucaauaaaacugaacguacggauauacugaacgcauggaucagaucggggcug

SEQ ID NO: 57226 - RNA, 86 nt, Mycobacterium bovis subsp bovis AF2122/97
cagcggacauguggcgcgcgcuggccaguguggcgaucagucguguguugcuccacugcugccaagucggccgucaucgucugcug

SEQ ID NO: 57227 - RNA, 58 nt, Mycobacterium bovis subsp bovis AF2122/97
cagcccggcggugcucgaggaagugcugucccguggcaugcucgaggugcugccgcug

SEQ ID NO: 57228 - RNA, 62 nt, Mycobacterium bovis subsp bovis AF2122/97
ccacaaacgagcuugucgcgugcucgaguuccuggcccaccggcagcacgagcucgucgugg

SEQ ID NO: 57229 - RNA, 62 nt, Mycobacterium bovis subsp bovis AF2122/97
cauucgcggaccaccgaucaauguccacaagguggcaggaucgggaugcguccaguucagug

SEQ ID NO: 57230 - RNA, 62 nt, Mycobacterium bovis subsp bovis AF2122/97
ccagccggugcuaucgguuucgaacgugaugugcgcguccucgaaacccagccaccucuugg

SEQ ID NO: 57231 - RNA, 84 nt, Mycobacterium bovis subsp bovis AF2122/97
ccaccgagcgggugguggucgccaacgccgaccaacugcugaucguggucgcgcuggcagacccgccgccacgcaccggccugg

SEQ ID NO: 57232 - RNA, 68 nt, Mycobacterium bovis subsp bovis AF2122/97
ccagccgccagcaucucggaucagcaacuucccgccgaagcgccacaagacccgcgugcuggcggcgg

SEQ ID NO: 57233 - RNA, 75 nt, Mycobacterium bovis subsp bovis AF2122/97
ccagcuacucggcggacaucggaugcguccggcugaccgaacgcuguuugcacuccgacccgccgacguugcagg

SEQ ID NO: 57234 - RNA, 80 nt, Mycobacterium bovis subsp bovis AF2122/97
ccaugucgagcugucggccaggguggccuggaugagugagucgcagcucgcuucugagauccuggugauugccgaccugg

SEQ ID NO: 57235 - RNA, 56 nt, Mycobacterium bovis subsp bovis AF2122/97
ccaugagcacccggauggccuggcuuagcccggucaugucguccaccggcuuaugg

SEQ ID NO: 57236 - RNA, 63 nt, Mycobacterium bovis subsp bovis AF2122/97
ccaucaccguguaguacaccguggcaucgugcaagucggcggucaccuucgcaucggugaugg

SEQ ID NO: 57237 - RNA, 67 nt, Mycobacterium bovis subsp bovis AF2122/97
augucgaccgcguuguaauaccacucugcguccucgcggcucaggcuuaugcagccguggcugacau

SEQ ID NO: 57238 - RNA, 64 nt, Mycobacterium bovis subsp bovis AF2122/97
auucgucgagcaauugcugguaugccgccgcuucuucuaacggauucagcuguacucgaugaau

SEQ ID NO: 57239 - RNA, 63 nt, Mycobacterium bovis subsp bovis AF2122/97
aguucgaggaucgagcugccaccgauccacuggaguugaaggccaaggagcacgaccucaacu

SEQ ID NO: 57240 - RNA, 61 nt, Mycobacterium bovis subsp bovis AF2122/97
aguuucuccaggguggcccgcagcgcgggggaauuccgcuugacgugaucgcugagacccu

SEQ ID NO: 57241 - RNA, 73 nt, Mycobacterium bovis subsp bovis AF2122/97
aguuugccgauuugauccagggugcgugguuggccgucauccaggccgaagcgcagccggaucaccuggugcu

SEQ ID NO: 57242 - RNA, 56 nt, Mycobacterium bovis subsp bovis AF2122/97
aucgcagccacggaguucgauuaccuggagaugugggcucaggauguggcugcgau

SEQ ID NO: 57243 - RNA, 65 nt, Mycobacterium bovis subsp bovis AF2122/97
augcauuggcgcugcaguacuuucacgcagcucccuggguugcguggucggaugcaggccagcgu

SEQ ID NO: 57244 - RNA, 60 nt, Mycobacterium bovis subsp bovis AF2122/97
caaaggccuuuccugcugggcuguguugaggucgcaaacccagccaggguaaggccuuug

SEQ ID NO: 57245 - RNA, 100 nt, Mycobacterium bovis subsp bovis AF2122/97
cagagcgcuggccgcggcgccuggcgcgcagcacggccugcagugcgucgcgggcacgcgcugugauuggcgcgaccacgccgcggucgguagagcucug

SEQ ID NO: 57246 - RNA, 97 nt, Mycobacterium bovis subsp bovis AF2122/97
cacgaucucgguuucggacggcaucuccaugggucaugaggggaugcacuucucgcugguuucccgugaggugaucgccgacagcgucgaagucgug

SEQ ID NO: 57247 - RNA, 67 nt, Mycobacterium bovis subsp bovis AF2122/97
caccagcucaucgccguagcugaggaccgcgaccccggugcucagcugcagugcggugggcgggaug

SEQ ID NO: 57248 - RNA, 76 nt, Mycobacterium bovis subsp bovis AF2122/97
caccaucuuugauauccgcaaccugcgguugccgcagcugucgcgggccucgguugucaucggaucguugguggug

SEQ ID NO: 57249 - RNA, 57 nt, Mycobacterium bovis subsp bovis AF2122/97
caccagggugcugccggugauuucgaugcuguaggagaagccgaccagcccguggug

SEQ ID NO: 57250 - RNA, 67 nt, Mycobacterium bovis subsp bovis AF2122/97
caccgagugcucgucguccugcucgacgaucuugaugacguugaucagcuuguugagcugcuuggug

SEQ ID NO: 57251 - RNA, 85 nt, Mycobacterium bovis subsp bovis AF2122/97
agccaucgggaaauguccauggggucagucuugcgcagcggcauccuguugcgccagcgccucccgcaggauccguccgguggcu

SEQ ID NO: 57252 - RNA, 55 nt, Mycobacterium bovis subsp bovis AF2122/97
agccgggcaucuggaaguggcucaaaaucaggugcagcgacuucauggccugguu

SEQ ID NO: 57253 - RNA, 82 nt, Mycobacterium bovis subsp bovis AF2122/97
agccuaauucgccgagcagacgcaaaagcgcccaggucugcccgaaaaggggagcuuuuaugacugcucggcgggaaggguu

SEQ ID NO: 57254 - RNA, 113 nt, Mycobacterium bovis subsp bovis AF2122/97
agugggugaaccggaccuggguggcgucgcgguuguggcugaucccggccaggccgacaaugucggcgaugcguccgcccagccgcagcaccucggucccguugccgcccacu

SEQ ID NO: 57255 - RNA, 61 nt, Mycobacterium bovis subsp bovis AF2122/97
accagcaccggccgcugcggcagccacgacaguugccgccaccaggcagccggugccaggu

SEQ ID NO: 57256 - RNA, 58 nt, Mycobacterium bovis subsp bovis AF2122/97
acaccaagcgcccgcagcuugcccaacgguggcugggccaagcugacggccuuggugu

SEQ ID NO: 57257 - RNA, 58 nt, Mycobacterium bovis subsp bovis AF2122/97
acacccaggggcugccgcagcgaauagacgucgaugccggggccggcacccucggugu

SEQ ID NO: 57258 - RNA, 63 nt, Mycobacterium bovis subsp bovis AF2122/97
acccagaggcuguugccgacgcgaugaacaugauugacugauuggcggucgcagcuucugugu

SEQ ID NO: 57259 - RNA, 70 nt, Mycobacterium bovis subsp bovis AF2122/97
accgguacugacaagcccggcgcggugcugguguuuccacacgccggcggcgcugccgcggcuuaccggu

SEQ ID NO: 57260 - RNA, 127 nt, Mycobacterium bovis subsp bovis AF2122/97
accuccauucgggguccguucgaaaugcuugucggguuguucaacgccgucaauguugagucuguuccgcucaauuuuacccacuugugcauccgccgccguuucgccgcgagcuuagaaucgaggu

SEQ ID NO: 57261 - RNA, 64 nt, Mycobacterium bovis subsp bovis AF2122/97
accucuggggcgcguucggacugcucgccgagauggucaagcagggccgcagcggcucgguggu

SEQ ID NO: 57262 - RNA, 62 nt, Mycobacterium bovis subsp bovis AF2122/97
acgcuguuggggccaacgaaguaugcgcgggugauccgccagaacugccggccccagggcgu

SEQ ID NO: 57263 - RNA, 78 nt, Mycobacterium bovis subsp bovis AF2122/97
acgucgcacccacuggcgggcgauccgcggagaggacuucaaauggguugucccgcacucgauccgcaaguccgucgu

SEQ ID NO: 57264 - RNA, 82 nt, Mycobacterium bovis subsp bovis AF2122/97
acgauuguguuugcgccgucuggcagccuggcgaugagcucguccacccgcgccagccggacggcuugcgcaaacugaucgu

SEQ ID NO: 57265 - RNA, 130 nt, Mycobacterium bovis subsp bovis AF2122/97
aauacgacggccgcgcggucgccggguuuucgauggguggcuucggcgcgcugaaguacgcagcaaaguacuacggccacuucgcgucggcgagcagccacuccggaccggcaagucugcgccgcgacuu

SEQ ID NO: 57266 - RNA, 83 nt, Mycobacterium bovis subsp bovis AF2122/97
aacucguugacaguggccaaggccaggucggccgcuccaagcgcggcaagcaacggagccuugaugucaucaauguucgaguu

SEQ ID NO: 57267 - RNA, 87 nt, Mycobacterium bovis subsp bovis AF2122/97
gaacuaaaccuacaccuggcgugcuaucgcgcauucgacgacauuggcagcgugauccacagccacccggugugggcgaccauguuc

SEQ ID NO: 57268 - RNA, 126 nt, Mycobacterium bovis subsp bovis AF2122/97
gaagaccgagccggcggcgaauuuguagaugucgcguuugcgcaggggcaugucagcguaugugcucgacgcgacgaauccacugcgcuugacgaggcgguacgucgcgccggcgagugcggcuuc

SEQ ID NO: 57269 - RNA, 57 nt, Mycobacterium bovis subsp bovis AF2122/97
gaagcugcugggccaguucguggauucgcuagaagccgagcucgcggcccagaguuc

SEQ ID NO: 57270 - RNA, 75 nt, Mycobacterium bovis subsp bovis AF2122/97
gaagccagugugaccgccuggauaccacacgauuucggguuugccccagugcucccagaggcgagucaccuguuc

SEQ ID NO: 57271 - RNA, 57 nt, Mycobacterium bovis subsp bovis AF2122/97
cuugggcguuugcguucgccgcgaccgcguugugcguaggcgaucgccucguccaag

SEQ ID NO: 57272 - RNA, 78 nt, Mycobacterium bovis subsp bovis AF2122/97
cuugugccgccgaacagacacaaaaccacccuauuucgaccagaaucgggugcuuuugcgucugcucggccaacuaag

SEQ ID NO: 57273 - RNA, 83 nt, Mycobacterium bovis subsp bovis AF2122/97
cuuugagcucuaggccaauguuguuccgcaugccgccgcgcagcuuacugacgaaggugaacagcuugcccuggaugccguag

SEQ ID NO: 57274 - RNA, 79 nt, Mycobacterium bovis subsp bovis AF2122/97
cuugcaauucuagguucgguuacuaagggccagcgcggcacgcaaacuguugcacugacuagugaagaaccuuugugag

SEQ ID NO: 57275 - RNA, 59 nt, Mycobacterium bovis subsp bovis AF2122/97
gacgaauuggccaggcugacagaggcauucaauuuaaugcugcgggcgcuggccgaguc

SEQ ID NO: 57276 - RNA, 112 nt, Mycobacterium bovis subsp bovis AF2122/97
gaccacucgugaaccggcgacgggcagcagucgaucaaucaacaggccggucaacgcgaaauggcccaagugguuggugccgaacugcaucucgaagccgucugcugugguc

SEQ ID NO: 57277 - RNA, 72 nt, Mycobacterium bovis subsp bovis AF2122/97
gacaggcugacguucugcacgcucgggccggccgcgacgaucgugguguccugcaggaucggcaacacgguc

SEQ ID NO: 57278 - RNA, 92 nt, Mycobacterium bovis subsp bovis AF2122/97
gacagcagcgccacuucgucaaggugaugccgcgugacuacaaacggguccugcaggcgaucgcccuggcugaacgugacggcguugauguc

SEQ ID NO: 57279 - RNA, 67 nt, Mycobacterium bovis subsp bovis AF2122/97
gacggcgcgccuugucgagaucgucgccgugggugacaccgacgaacgcgaccaggcccugcccguc

SEQ ID NO: 57280 - RNA, 75 nt, Mycobacterium bovis subsp bovis AF2122/97
gacugauagacguccauaucgccaugccuggccugcagaucgaccgccagagcaugggcguggacguugucgguc

SEQ ID NO: 57281 - RNA, 69 nt, Mycobacterium bovis subsp bovis AF2122/97
gacgcauggccaaccucccgacugguacccgcgccggcucgguuacgccgguugugguuggccgugcuc

SEQ ID NO: 57282 - RNA, 56 nt, Mycobacterium bovis subsp bovis AF2122/97
gagcagacgcagaagucgccgauuucaccggaaaucggggacuucugcgucugcuc

SEQ ID NO: 57283 - RNA, 79 nt, Mycobacterium bovis subsp bovis AF2122/97
cucuccaggcgaaucaccccgccgcgcgcggugaccguucgucggccggguguuggugagggugacucgccgaggaggg

SEQ ID NO: 57284 - RNA, 128 nt, Mycobacterium bovis subsp bovis AF2122/97
cucguucgguggaaaaguccaggaaccgguaggccagcuugucgccacgaaccuucgcccacuuuucgacgugacgaaccagguugguguuggcugggaaccugaucuuuccauucacgaugaacggg

SEQ ID NO: 57285 - RNA, 96 nt, Mycobacterium bovis subsp bovis AF2122/97
cugcuggccgccugcguccggucgcgggcugacuccggucaccaggagcgugccgcuggccagaucuccccgcgggccgcgcgggauaagccgcgg

SEQ ID NO: 57286 - RNA, 94 nt, Mycobacterium bovis subsp bovis AF2122/97
cugcucgcguugcugacauccaggcgaccggccgggguacccgacuugcggcgacuguucccgaccggcuuugacgagcagcggcgcgcggcgg

SEQ ID NO: 57287 - RNA, 88 nt, Mycobacterium bovis subsp bovis AF2122/97
cugcgaguugauguccucaagccggcguuccagcucgggcaccaaaugcugugcucgaacccggguuucggcgaaugacaacuugcag

SEQ ID NO: 57288 - RNA, 75 nt, Mycobacterium bovis subsp bovis AF2122/97
cugcgcaccgcggcggcgcuggcucgguugaaucagcguaacggcuucgacugcccaggcugcgcguggccggag

SEQ ID NO: 57289 - RNA, 63 nt, Mycobacterium bovis subsp bovis AF2122/97
cugguugugccgauagccgugaagcccuccgcgagguaggccagggccgacggcacaucccag

SEQ ID NO: 57290 - RNA, 75 nt, Mycobacterium bovis subsp bovis AF2122/97
cugguagucaccgccgcgguuggugcgcauggugcgccgugcgaucuggacggcggcggucaccgcgaucaucag

SEQ ID NO: 57291 - RNA, 74 nt, Mycobacterium bovis subsp bovis AF2122/97
cuccaagggcaagccgauggccgcggacgccgaccucgacggacuggccaagcggaccgucggcaugaccggag

SEQ ID NO: 57292 - RNA, 64 nt, Mycobacterium bovis subsp bovis AF2122/97
cgucggccgcguguucgacugggugguggccgagcuggucgccaccacucaggccgcggucacg

SEQ ID NO: 57293 - RNA, 120 nt, Mycobacterium bovis subsp bovis AF2122/97
cguccuuguaguagccgacgggaauguugcccuucuuggcgagcgugcgcgcgggucgcacugcuuggcgccuggugcaccggucgccgggcggcuccuccccagggcgcuccagguucg

SEQ ID NO: 57294 - RNA, 77 nt, Mycobacterium bovis subsp bovis AF2122/97
cgucaaagguuuucagcguguaggagguguaguacuugaacgcacccaaaaacgucggaaaccggaacuuuuuggcg

SEQ ID NO: 57295 - RNA, 88 nt, Mycobacterium bovis subsp bovis AF2122/97
cgugcggaacugagcggcgaaggugagcuggggauccaccggcgccugaucgagccccagucgcuuugucucgagguugaucuccacg

SEQ ID NO: 57296 - RNA, 79 nt, Mycobacterium bovis subsp bovis AF2122/97
cgucuacgaagauccgcccgcggcccugcaccucgaguccggcguugugcaggucgagguggucgguuugucccugacg

SEQ ID NO: 57297 - RNA, 82 nt, Mycobacterium bovis subsp bovis AF2122/97
cguucucgcgcaggaugaggcuugccaccgucgccgcggagaccagggcaucggugccggccuuuccggagcgcagcgagcg

SEQ ID NO: 57298 - RNA, 114 nt, Mycobacterium bovis subsp bovis AF2122/97
cguugaagaaggccacggcgaucacgccggggcuggagucaccgaccaucgccccgcuggccgacccggacuggguggcaauccgcgcccuggugccgcgccgggacgucaacg

SEQ ID NO: 57299 - RNA, 66 nt, Mycobacterium bovis subsp bovis AF2122/97
cguucagcacggccgacagcgagaaccugcaaaucccgcaguacaagcauucggucgugaugggcg

SEQ ID NO: 57300 - RNA, 113 nt, Mycobacterium bovis subsp bovis AF2122/97
ccgcccgcgcucggcgccgugcuacccgcccggggcauggccaagcuggcuuucgaugugaccccgccggccuggcuggagcccgggcaguggugggcccugguucgggucgg

SEQ ID NO: 57301 - RNA, 69 nt, Mycobacterium bovis subsp bovis AF2122/97
ccgccgagguaggucagggcguauuugucguagcggguugcgaugccgcgccacugcuugagucgaugg

SEQ ID NO: 57302 - RNA, 89 nt, Mycobacterium bovis subsp bovis AF2122/97
ccgagccgccgccgcggacugucccgagcgcaccaggaaucgaaccaggcuuccuugugucaucgggcaggucgcaaauccggugucgg

SEQ ID NO: 57303 - RNA, 57 nt, Mycobacterium bovis subsp bovis AF2122/97
cccgggccuguucgggugacagguacugcgccgugccgaucacugcugcggucuggg

SEQ ID NO: 57304 - RNA, 91 nt, Mycobacterium bovis subsp bovis AF2122/97
cccgcuuggccgggcgaucgucgcggaagcucgucggcgugguaucgccauaccgcccgccaaggacuuccgcgcggucccgggcugcggg

SEQ ID NO: 57305 - RNA, 56 nt, Mycobacterium bovis subsp bovis AF2122/97
cccgauccacggugaccaggggugccuugaucaacugcuggugcaccuuguuuggg

SEQ ID NO: 57306 - RNA, 115 nt, Mycobacterium bovis subsp bovis AF2122/97
cccgcaggccgacuucggcguguccggugcccagcaccgaccagugccggccgccgagcucgauguggaugucggcuugcucgguguuggugcacaccgccuuggccccgucggg

SEQ ID NO: 57307 - RNA, 78 nt, Mycobacterium bovis subsp bovis AF2122/97
cccgcgccaccgccgggacaagauccgcacaugccgaauagugcgaugggauauugcccuggcgguggcuuugguggg

SEQ ID NO: 57308 - RNA, 88 nt, Mycobacterium bovis subsp bovis AF2122/97
ccggcgaucgucaaguuucucagcgagcaggugcuuucccgcgcgacggagcgagugcgugcugggguacucggcgaaauacguucgg

SEQ ID NO: 57309 - RNA, 100 nt, Mycobacterium bovis subsp bovis AF2122/97
ccggugaccgcgacggguuugguguccgcacugcugcucaccacccgcggcaccgcguugacgcucgaccagcugcaccacacguugcaggacucacugg

SEQ ID NO: 57310 - RNA, 91 nt, Mycobacterium bovis subsp bovis AF2122/97
ccggcgacggcaucgcccugggauugugggcgggcgucgcggucagcgaucucgaguucauccaguuccaccccacgaugcuuuuugccgg

SEQ ID NO: 57311 - RNA, 84 nt, Mycobacterium bovis subsp bovis AF2122/97
ccgcgcgucgggaagggcuacaccucgacgaggccgacgacgaguucucgacggccgaacguguggaguccgcccugcgcacgg

SEQ ID NO: 57312 - RNA, 72 nt, Mycobacterium bovis subsp bovis AF2122/97
ccgcgaacuggccagcccgcacaaccacuaugugggugcgcgcagcgguggcacgcuggucgguuacgccgg

SEQ ID NO: 57313 - RNA, 69 nt, Mycobacterium bovis subsp bovis AF2122/97
ccgcuucaucgucguggcagguguugggcugauuuuggucaacccagcaccugccaggacgggcuacgg

SEQ ID NO: 57314 - RNA, 71 nt, Mycobacterium bovis subsp bovis AF2122/97
ccggaucccucagcugucaugguuggugauugucccagaagccgaaccgugcgcuggagcugggauacugg

SEQ ID NO: 57315 - RNA, 102 nt, Mycobacterium bovis subsp bovis AF2122/97
ccggccagaacugcucgggcgugaacaggccuugcgagacagcacccgggaagagggucuggaugaaagccuuguugaugucugucacguacucggggucgg

SEQ ID NO: 57316 - RNA, 79 nt, Mycobacterium bovis subsp bovis AF2122/97
ccuggaaaauauucaucgaguacagcugaauccguuagaagaagcggcggcauaccagcaauugcucgacgaauucggg

SEQ ID NO: 57317 - RNA, 87 nt, Mycobacterium bovis subsp bovis AF2122/97
ccggugcccggaucucugcgggguaguucggcugggucgccagaucguugccgaaaagcgcugccuccgaggugaaucggucgccgg

SEQ ID NO: 57318 - RNA, 73 nt, Mycobacterium bovis subsp bovis AF2122/97
ccggugucgaaacugcaaccacgcaccgaugcgucggcgugucuugugcgugguugcagugucgcgaagccgg

SEQ ID NO: 57319 - RNA, 87 nt, Mycobacterium bovis subsp bovis AF2122/97
ccguggugcgugauggcgaggcggcgcgccgccaccugcuggaagcaaaccugcggcuggugguaucgcuggccaagcgcuacacgg

SEQ ID NO: 57320 - RNA, 71 nt, Mycobacterium bovis subsp bovis AF2122/97
ccguuccucgacggcgcgugugucaacgacccugaccauagcuggguggcgaugcaugagucguggaaugg

SEQ ID NO: 57321 - RNA, 72 nt, Mycobacterium bovis subsp bovis AF2122/97
ccucgaagccgcacuacggucaaugcgcugcgcucgcagugaaauugaaaacgccguugcugagcagcgagg

SEQ ID NO: 57322 - RNA, 83 nt, Mycobacterium bovis subsp bovis AF2122/97
cgaacccgacgaagcggccgucgaacauggcggccugauacaccaccggggcgugguuggcgauggcacgucgcgucgcgucg

SEQ ID NO: 57323 - RNA, 71 nt, Mycobacterium bovis subsp bovis AF2122/97
cgaagaaguccagcagaucgaucucgccggccucaccccagucggcgaucauccgucggacuugaucuucg

SEQ ID NO: 57324 - RNA, 77 nt, Mycobacterium bovis subsp bovis AF2122/97
ccuuuugaucacccccuugaccuugcaccauggcgucugaaaacggaacaucgguagccgucaaauugaccagaagg

SEQ ID NO: 57325 - RNA, 59 nt, Mycobacterium bovis subsp bovis AF2122/97
ccugggacagcuggaaguuaucggacgcggccguguucauaccgaccaccuguccuagg

SEQ ID NO: 57326 - RNA, 65 nt, Mycobacterium bovis subsp bovis AF2122/97
cgacggucagcuguguccgcacaaccgggcacccucggugacggacugcacagcgauggaccgcg

SEQ ID NO: 57327 - RNA, 76 nt, Mycobacterium bovis subsp bovis AF2122/97
cgacgucuugcccaagcccggcggaccggacagcagaaugugauccggugugccgccgcgguuuuuggcucccucg

SEQ ID NO: 57328 - RNA, 73 nt, Mycobacterium bovis subsp bovis AF2122/97
cgacgacaacccgaugcccggcgggauguaccgcaaccaagugugguuucccuacccgggcagcaaugucgcg

SEQ ID NO: 57329 - RNA, 80 nt, Mycobacterium bovis subsp bovis AF2122/97
cgacgacgaguacaccaaggccgucagcuuggcccagccaccguugggcaagcugcgggcgcuuggugucaaucccgacg

SEQ ID NO: 57330 - RNA, 78 nt, Mycobacterium bovis subsp bovis AF2122/97
cgacacccugcucgucaugucgguagagccuggcuucgguggccagcgguucauucccgaggugcugagcaaggugcg

SEQ ID NO: 57331 - RNA, 118 nt, Mycobacterium bovis subsp bovis AF2122/97
cgacaggucccgggugugcgaauccgggugguccagcagcgcguacagcaucgauggcaccaacauggucgcuguaaugcguugcuccucaaugauucugaguaccucggccgggucg

SEQ ID NO: 57332 - RNA, 77 nt, Mycobacterium bovis subsp bovis AF2122/97
cgccgacgucccauaaccgcugcccgggccuuggcgccagcgcagccagggucagcacgcggauuggguguuuggug

SEQ ID NO: 57333 - RNA, 67 nt, Mycobacterium bovis subsp bovis AF2122/97
cgcccacugggggccggcugcgguagcagcguuggauagcgcgcugcgucgggccucggaauggucg

SEQ ID NO: 57334 - RNA, 75 nt, Mycobacterium bovis subsp bovis AF2122/97
cgccauucggacucguugccgucccgggugcuccgucgccgauuagcggacgccccaacaacguuucgguuggug

SEQ ID NO: 57335 - RNA, 99 nt, Mycobacterium bovis subsp bovis AF2122/97
cgccagagacacggaucgcgcgucucggcgaguggggcgcagucgggcuauauguuucauucagacgagaggcgugaacacccugaaaucucuaggacg

SEQ ID NO: 57336 - RNA, 56 nt, Mycobacterium bovis subsp bovis AF2122/97
cgccagcaccaucugcgaucccggcuuccuggugcuggucgaaggugugcucggcg

SEQ ID NO: 57337 - RNA, 66 nt, Mycobacterium bovis subsp bovis AF2122/97
cgaugcggccggguccacccggcugaucuucacgcgccaggaaggucugucggaccuggccgcgcg

SEQ ID NO: 57338 - RNA, 61 nt, Mycobacterium bovis subsp bovis AF2122/97
cgaugagucggcagguggcugucagagcuuguugagcgccugggccagugccgacuucuug

SEQ ID NO: 57339 - RNA, 64 nt, Mycobacterium bovis subsp bovis AF2122/97
cgagguacuccagugcgucggucuggaaucgacgauccagccaagacgcgucggggccaccccg

SEQ ID NO: 57340 - RNA, 65 nt, Mycobacterium bovis subsp bovis AF2122/97
cgauccgcugacuccgauccuggcggugggcgccgcagcaucggcgauugucggcagcaauaucg

SEQ ID NO: 57341 - RNA, 67 nt, Mycobacterium bovis subsp bovis AF2122/97
cgcgcuaggggucgcgcugcagcgcgccgaccauguugugguggcgugcagcgccaucucucaugcg

SEQ ID NO: 57342 - RNA, 77 nt, Mycobacterium bovis subsp bovis AF2122/97
cgcgcucacccgcgccgggauagucaccgcggccgaugcgcgggccgcgguggcagaaaguccggagcaguagcgug

SEQ ID NO: 57343 - RNA, 76 nt, Mycobacterium bovis subsp bovis AF2122/97
cgccgccgcgcacgccgccuggcgugguguccgcaccguugaggagcaggauauccaggcggcagcagaacuggcg

SEQ ID NO: 57344 - RNA, 77 nt, Mycobacterium bovis subsp bovis AF2122/97
cgcgguggccagggcugccacagucgccugggcgcccuuguccucggccgacgucgguagccccgcccgauccagcg

SEQ ID NO: 57345 - RNA, 80 nt, Mycobacterium bovis subsp bovis AF2122/97
cgcgugcugggcgagcagacacagagucgcaucaaaaccgccgauuuugugcgacucugugucugcucgcggggugcgcg

SEQ ID NO: 57346 - RNA, 100 nt, Mycobacterium bovis subsp bovis AF2122/97
cgcgaucaauaacggugcgacggugcugguggucagugacgccgggaccccggugaucagcgaucccggcuaucggcuggucgcggcgugcaucgacgcg

SEQ ID NO: 57347 - RNA, 65 nt, Mycobacterium bovis subsp bovis AF2122/97
cgcucuggccgggcggcauggagaucacccaguuggucuugaugccuccgcgagccgccgagaug

SEQ ID NO: 57348 - RNA, 61 nt, Mycobacterium bovis subsp bovis AF2122/97
cgcugggucuccggcggcucgguagcaacguauuccgaagcaaugcgcacggcauccagcg

SEQ ID NO: 57349 - RNA, 84 nt, Mycobacterium bovis subsp bovis AF2122/97
cggcagcucccaacgguggccccggcgguuugcuauucggugacgguggggccggcuauaccggcgguaacggugggagugccg

SEQ ID NO: 57350 - RNA, 92 nt, Mycobacterium bovis subsp bovis AF2122/97
cggccauggcuggcagcaucgaccugccgcagcguugcuauuccggauuggaacugcgcgacgaccggcugguguugagcccgcaauggccg

SEQ ID NO: 57351 - RNA, 60 nt, Mycobacterium bovis subsp bovis AF2122/97
cggccagcacgucacgcaggccgauauucgagucgaaccgucgccgugacguguugaacg

SEQ ID NO: 57352 - RNA, 83 nt, Mycobacterium bovis subsp bovis AF2122/97
cggacgcgguaccgauauuggccaagaagcugaagcccauccggucaacacaguccugggccaacugccgguagaccuguucg

SEQ ID NO: 57353 - RNA, 69 nt, Mycobacterium bovis subsp bovis AF2122/97
cggagagcguggcaucgcucggaagguauugggauuccaaauauuucguggcgaugcgcuugguuuccg

SEQ ID NO: 57354 - RNA, 128 nt, Mycobacterium bovis subsp bovis AF2122/97
cgcuuguuccgccugcgcugccgccgugcugagccaggcuagguacuggguugcgacggccaucaucgccgccgcggacggacccagccaggcgccacuagucaguucggaugugacggagccaagcg

SEQ ID NO: 57355 - RNA, 66 nt, Mycobacterium bovis subsp bovis AF2122/97
cggcgagcagacgcaaaacccccuucucgucggcgugucgagggacuuaugcgucugcuagcgccg

SEQ ID NO: 57356 - RNA, 61 nt, Mycobacterium bovis subsp bovis AF2122/97
cggccugucucggcaagccuggucgaccccgaggaugaccugacgccggccagauaugccg

SEQ ID NO: 57357 - RNA, 100 nt, Mycobacterium bovis subsp bovis AF2122/97
cggccuuucgguuguggggguggcgccgugaccgaccuggccggcaccacccggcugcugcgcgcucagggcgucaccgccccggccggcuuucgggccg

SEQ ID NO: 57358 - RNA, 92 nt, Mycobacterium bovis subsp bovis AF2122/97
cggccugcgcaucgaagaugguuugcugaagaagcugggugccgaggcgguggcucagcgggucaacgaggcgcugcacaaugcgcaggccg

SEQ ID NO: 57359 - RNA, 72 nt, Mycobacterium bovis subsp bovis AF2122/97
cggccucuaccagccggcgcagcagcgccuuuucggcaacgaugcucgcguaguagcccgcguuggcggccg

SEQ ID NO: 57360 - RNA, 72 nt, Mycobacterium bovis subsp bovis AF2122/97
cggccggguccaagcagcgacuagucaaguuggggccggaaggauuugcucguuggcugcgggagucggccg

SEQ ID NO: 57361 - RNA, 86 nt, Mycobacterium bovis subsp bovis AF2122/97
cggcgaucaccagccggcgcauggucaaagcgccgcuccuucuggucgcucugcucugcaucgucgccggcgcggucaaagcgccg

SEQ ID NO: 57362 - RNA, 80 nt, Mycobacterium bovis subsp bovis AF2122/97
cggcggcacagccaacagccagcugcccgguccgccgagccggucgugggcggccgaggcgcuggcggucaaggccgccg

SEQ ID NO: 57363 - RNA, 62 nt, Mycobacterium bovis subsp bovis AF2122/97
cgggucuauggguggaugcucgacggcguuccggugguggcgaugcaccgcaauaugaccug

SEQ ID NO: 57364 - RNA, 59 nt, Mycobacterium bovis subsp bovis AF2122/97
cggggcugccggugagugcgcgauaggugcucgcgaucugcucguagcggcggcgcccg

SEQ ID NO: 57365 - RNA, 56 nt, Mycobacterium bovis subsp bovis AF2122/97
cggguggugcgggcagccgaccggagaugaaagccguugguggacagcgcuucccg

SEQ ID NO: 57366 - RNA, 126 nt, Mycobacterium bovis subsp bovis AF2122/97
cggugaugcugugacggaucggcgggccaacacgaggaauucgcacccgcugccggcgugaccaacgccacgcuggcagcaaucggguauccgaucgcguuggccagcaagcuguuggcgauaucg

SEQ ID NO: 57367 - RNA, 64 nt, Mycobacterium bovis subsp bovis AF2122/97
cggucgccgcggucgugcugggugcgaugaucugguccgcacaccgcgaugacuccggcgagcg

SEQ ID NO: 57368 - RNA, 65 nt, Mycobacterium bovis subsp bovis AF2122/97
cgggcgggcccggagggccagagggcacauagcugcccuccucguggcgagccgggccacgcccg

SEQ ID NO: 57369 - RNA, 60 nt, Mycobacterium bovis subsp bovis AF2122/97
cggggaucggcacccuggccgcaugguucgccgcggccggagagguugucguguuccucg

SEQ ID NO: 57370 - RNA, 107 nt, Mycobacterium bovis subsp bovis AF2122/97
cggggauguccuacguguggugggcgcuggcggucaucgucguugccggacucaccguuaccgccaggaugacgccgcagcgcucgcuuacgcgcggacugaccccg

SEQ ID NO: 57371 - RNA, 65 nt, Mycobacterium bovis subsp bovis AF2122/97
cgggcguggcccggcucgccacgaggagggcagcuaugugcccucuggcccuccgggcccgcccg

SEQ ID NO: 57372 - RNA, 99 nt, Mycobacterium bovis subsp bovis AF2122/97
cggcggugaccagcaccacgccgaugaaaccgguggccaugccgccugcgaagacccgccaggugcgcgcgaucuggaucauuugcgucggucccuccg

SEQ ID NO: 57373 - RNA, 104 nt, Mycobacterium bovis subsp bovis AF2122/97
cggcguggucggcggcgucguuggcggcguggucaccggcguggucggcggcgucguuggcggcguggucaccggcguggucggcggcguggucggcggcgucg

SEQ ID NO: 57374 - RNA, 63 nt, Mycobacterium bovis subsp bovis AF2122/97
cggcugcagugcgacgacgagaaaccggcggcaauaguggccaucucuccguugcugcagcug

SEQ ID NO: 57375 - RNA, 59 nt, Mycobacterium bovis subsp bovis AF2122/97
cggcuggccagggcguuuccgcucuacgacgggcucgaggaguggagucuggucggccg

SEQ ID NO: 57376 - RNA, 55 nt, Mycobacterium bovis subsp bovis AF2122/97
cgggcacggaucgugauuacgcauagcguguaaaagaacuuugcauccgugcccg

SEQ ID NO: 57377 - RNA, 57 nt, Mycobacterium bovis subsp bovis AF2122/97
gcacgcgagcuggguuuagaacgucgugagacaguucggucucuauccgccgcgcgc

SEQ ID NO: 57378 - RNA, 58 nt, Mycobacterium bovis subsp bovis AF2122/97
gcacggguucguugcugugcaugugcucgcaguaccggcgcagcaucucagccagugc

SEQ ID NO: 57379 - RNA, 61 nt, Mycobacterium bovis subsp bovis AF2122/97
gcagaugagugcagaggaucucgaaaaguaugaaaccgagauggagcucucgcuguaucgc

SEQ ID NO: 57380 - RNA, 60 nt, Mycobacterium bovis subsp bovis AF2122/97
gcacgucguaucuggacaaccgggcgaucgacaccgcccagauccagccguacgacgggc

SEQ ID NO: 57381 - RNA, 62 nt, Mycobacterium bovis subsp bovis AF2122/97
gcacgucgucgcgggacagguaccgcgcccgcagcgcggcgauuugcaacgcaacggcgugc

SEQ ID NO: 57382 - RNA, 71 nt, Mycobacterium bovis subsp bovis AF2122/97
gcagcuggccugcgcggguggcuuuccggaaguugugcagcgcccggcgggucgcgcccgcagccgguggu

SEQ ID NO: 57383 - RNA, 76 nt, Mycobacterium bovis subsp bovis AF2122/97
gauguugucgauucaccagcggccguucgaucccgccgaccgcuccgagccuggccacugggaaggagaucucauc

SEQ ID NO: 57384 - RNA, 108 nt, Mycobacterium bovis subsp bovis AF2122/97
gaugcacaagucaaaaccgcguuggcguuuguccaaguaguaggcgagaucaccggcgauauaugccgguuugccgucgcucuugaucacgacgcgguccuugucguc

SEQ ID NO: 57385 - RNA, 69 nt, Mycobacterium bovis subsp bovis AF2122/97
gaugcacccagugagguuucaucgaucggccugcucaccuuguagcaggcggcuucacugauguugauc

SEQ ID NO: 57386 - RNA, 61 nt, Mycobacterium bovis subsp bovis AF2122/97
gaugcugcucggacccagcggcugcggcaagacgacacugcuuuccugucugggcggcauu

SEQ ID NO: 57387 - RNA, 57 nt, Mycobacterium bovis subsp bovis AF2122/97
gaugcuggagguguugagcaccgcuucuaacgaucccgaugcgcgccgccagcuauc

SEQ ID NO: 57388 - RNA, 79 nt, Mycobacterium bovis subsp bovis AF2122/97
gaucuucgaccaaggggagaagcagcugaaguuggcgcuugagcaucgccggcaacaccuuucccccuucgagcagauc

SEQ ID NO: 57389 - RNA, 70 nt, Mycobacterium bovis subsp bovis AF2122/97
gauucgccgucauggguuggcuaccuccuguugaacccaaccgauauccgccaacucaggcggacgaauc

SEQ ID NO: 57390 - RNA, 79 nt, Mycobacterium bovis subsp bovis AF2122/97
gauacgcagacacggcggugacgcgagaauauaauugacuccacgucauucggucaauuuggucgccgguuuuuguguc

SEQ ID NO: 57391 - RNA, 92 nt, Mycobacterium bovis subsp bovis AF2122/97
gaguucgcguagaauagcgaaacacgggaucgggcgaguucgaccuuccgucggucucgcccuuucucguguuuauacguuugagcgcacuc

SEQ ID NO: 57392 - RNA, 73 nt, Mycobacterium bovis subsp bovis AF2122/97
gaggucgauggcgaugcgcaccccgucgcgcaucgucacauagcacgaggaguagcgcaucccacgauaucuc

SEQ ID NO: 57393 - RNA, 69 nt, Mycobacterium bovis subsp bovis AF2122/97
gaucgaggcaccaggugcauugugcaccacauucuggcgauguuggugagguuuguuccugcgcccguc

SEQ ID NO: 57394 - RNA, 59 nt, Mycobacterium bovis subsp bovis AF2122/97
gauccgcccaggcucccgcucgacgacggcaccgucgugaucgugugccucggcugguc

SEQ ID NO: 57395 - RNA, 66 nt, Mycobacterium bovis subsp bovis AF2122/97
gauccggaggggcagcucggcuccgcgucgcgcgcgcgauucggcgauguguugccguucuugguc

SEQ ID NO: 57396 - RNA, 88 nt, Mycobacterium bovis subsp bovis AF2122/97
gagcucaacuagcugcuagguugccgcacuagacugcugcaaaugcaggucuauacgucggcaacgcacuggggcguguucaccgcuc

SEQ ID NO: 57397 - RNA, 68 nt, Mycobacterium bovis subsp bovis AF2122/97
gaggauaccccgggcggugucgagaacgcggccagaguucgagccgcucgagauugcagcgggcccuc

SEQ ID NO: 57398 - RNA, 64 nt, Mycobacterium bovis subsp bovis AF2122/97
gcaggcuuccagccacagcccggcggcggucugagacucgucgaugcggugguaggacgccagc

SEQ ID NO: 57399 - RNA, 73 nt, Mycobacterium bovis subsp bovis AF2122/97
gcaugacuuccagcaacgccgacugcaccuucgccggagcccgguugaucucgucggcgagcaggaaguuggc

SEQ ID NO: 57400 - RNA, 77 nt, Mycobacterium bovis subsp bovis AF2122/97
gccaccgcacaccacgucggggugaaauucuccaccaacgggguccggaucacccccgagguggccacgcggcuggc

SEQ ID NO: 57401 - RNA, 59 nt, Mycobacterium bovis subsp bovis AF2122/97
gccaaaucgagccgagagugggcgacccggaagggcccacacuccuggcuggauucggc

SEQ ID NO: 57402 - RNA, 103 nt, Mycobacterium bovis subsp bovis AF2122/97
gcauugugguggaugaucggccuguuggucgccgccggcgugcugggucugauggugguguugccgaucgguggcgccgacaugccgguggucaucucgaugc

SEQ ID NO: 57403 - RNA, 68 nt, Mycobacterium bovis subsp bovis AF2122/97
gccaagucgucggcccggucgcgggcaccggccuugccggccuugacgagcgggccggcaaucugggc

SEQ ID NO: 57404 - RNA, 83 nt, Mycobacterium bovis subsp bovis AF2122/97
gcccccuggguggucagcgucgaugaccaugucgaccccacgguguggucgauggugaugacgcuggcgcuggacugcggggc

SEQ ID NO: 57405 - RNA, 74 nt, Mycobacterium bovis subsp bovis AF2122/97
gcccggccagcgcgaugcggaacgcggugucggcggcgcuguugaugaugcggauccggauucgcuggccaggc

SEQ ID NO: 57406 - RNA, 63 nt, Mycobacterium bovis subsp bovis AF2122/97
gcccagagugcgcaggcucucgcgcugcuuccagcgugcuccgauggugcugcgcaccugggu

SEQ ID NO: 57407 - RNA, 73 nt, Mycobacterium bovis subsp bovis AF2122/97
gccacggugugcuggugugcgcgccgaccggcgcuggcaagacgguggucggcgaguucgccgugcaccuggc

SEQ ID NO: 57408 - RNA, 59 nt, Mycobacterium bovis subsp bovis AF2122/97
gccacucggggccgcugcggccuggaaaaauuggucgggcacgggcggccgcgggucgc

SEQ ID NO: 57409 - RNA, 77 nt, Mycobacterium bovis subsp bovis AF2122/97
gccgcggggagcgcugggcagucucgaggaccugucugucugggucgcgucgugccagcagcgcuguccgccgcggc

SEQ ID NO: 57410 - RNA, 61 nt, Mycobacterium bovis subsp bovis AF2122/97
gccgcgcgccggcugcggcccaagcggaugccgccaagccgcaaggcucggcgccagcggc

SEQ ID NO: 57411 - RNA, 65 nt, Mycobacterium bovis subsp bovis AF2122/97
gccgccugccacuggugucacgucauggcccacgagucauucgacgacgacgagguggccgcggc

SEQ ID NO: 57412 - RNA, 66 nt, Mycobacterium bovis subsp bovis AF2122/97
gccgccagcagugcgggcgaucgugacgagccugaucucggugagcccauaccgcugaauugcggc

SEQ ID NO: 57413 - RNA, 79 nt, Mycobacterium bovis subsp bovis AF2122/97
gccgaugccgcgcugcgcgccuugauccggcugucggagaauccagacaccggaugggacgagcucaacgcggcucugc

SEQ ID NO: 57414 - RNA, 76 nt, Mycobacterium bovis subsp bovis AF2122/97
gcccgcacugccggugucgaguggguucgggggcgggugguagcccauccaggcgaugguggcaaccgaugcgggc

SEQ ID NO: 57415 - RNA, 60 nt, Mycobacterium bovis subsp bovis AF2122/97
gccgagcgugaacucagggcggaaaaaucgccgaauucccgccccagaugcacgcucggc

SEQ ID NO: 57416 - RNA, 77 nt, Mycobacterium bovis subsp bovis AF2122/97
gcccugccgguacuuggucaccuccgagcccacggcggucaccacgccggcgaucucguggccagggaccacagggu

SEQ ID NO: 57417 - RNA, 89 nt, Mycobacterium bovis subsp bovis AF2122/97
gccggaucuggccaaggcuggagcgcacagcgcgggcggcccggagccggccgcgcgguagcggucuagguccaucggccguauuaggc

SEQ ID NO: 57418 - RNA, 60 nt, Mycobacterium bovis subsp bovis AF2122/97
gccggcggcgacgucugccaucuccgguguguuuggcauggucaggcggccgucgucggc

SEQ ID NO: 57419 - RNA, 102 nt, Mycobacterium bovis subsp bovis AF2122/97
gccgggucaccgacgccucgguggucgucggggcggcggccgcgcacuucggcuggggccgcaccgacuaccaccgacuggccggcgccgugguggccgggc

SEQ ID NO: 57420 - RNA, 59 nt, Mycobacterium bovis subsp bovis AF2122/97
gccguggaucgagcgacccuguuucugcaaggcaccguacuacuggucacgaucauggc

SEQ ID NO: 57421 - RNA, 86 nt, Mycobacterium bovis subsp bovis AF2122/97
gcuugacgcccucgaugugccaggugccgucggguuguucgaacgcuuugguucgacccgcgccgacaucggaaccggcgucgggc

SEQ ID NO: 57422 - RNA, 64 nt, Mycobacterium bovis subsp bovis AF2122/97
gcuggugacccaggcgccggucggugugauggugggucaucugcagguuccuggguugaccggc

SEQ ID NO: 57423 - RNA, 69 nt, Mycobacterium bovis subsp bovis AF2122/97
ggaacgucuaggccacuaccgaagacgccggugcccacaccgacuuccuggaguugccggaccaguucc

SEQ ID NO: 57424 - RNA, 61 nt, Mycobacterium bovis subsp bovis AF2122/97
ggaccaugcaucggaagaaccggcaugacaauguucaggccgaguucgucaugcagcuucc

SEQ ID NO: 57425 - RNA, 107 nt, Mycobacterium bovis subsp bovis AF2122/97
ggaccuguaugggcggggagaaccggcugaugcggugacgguggccgccgaacuggaucgccgugggcugcugcgccgcaucggcggugcucccuaccugcacaccc

SEQ ID NO: 57426 - RNA, 61 nt, Mycobacterium bovis subsp bovis AF2122/97
ggacgcggggcguaacuuccuaccggcgcccgggccggugacaaaguuccacccgccgucc

SEQ ID NO: 57427 - RNA, 85 nt, Mycobacterium bovis subsp bovis AF2122/97
ggacgcguuggcgcuggccgaagccgaccggcccagcgaugacaucgacuucaaggacguucggcuuucagcgcgacgaucaucc

SEQ ID NO: 57428 - RNA, 79 nt, Mycobacterium bovis subsp bovis AF2122/97
ggacacaacgacguccugcgcgugguacucgucggcggccagccccaccgcggcggccuuaacgcgcagcggaaugucc

SEQ ID NO: 57429 - RNA, 69 nt, Mycobacterium bovis subsp bovis AF2122/97
ggacuguucaacuccgguaguuucaacaccggcaucgguaauagcggaaccggcaguacugggcucuuc

SEQ ID NO: 57430 - RNA, 94 nt, Mycobacterium bovis subsp bovis AF2122/97
gcguuggucgcgcuggcguguaugguguuggccgggugcacggucagcccgccgccggcaccccagagcacugauacgccgcgcagcacaccgc

SEQ ID NO: 57431 - RNA, 68 nt, Mycobacterium bovis subsp bovis AF2122/97
gcguuggugaagugcaacacgaacguuggaucggcuucgaaccagcgaaugucguugccucggcgagc

SEQ ID NO: 57432 - RNA, 56 nt, Mycobacterium bovis subsp bovis AF2122/97
gcucagccgugugcggauacuugacgcugugacgcagcaccgcaucucgguugagc

SEQ ID NO: 57433 - RNA, 66 nt, Mycobacterium bovis subsp bovis AF2122/97
gcucgucaacgccuuuuucagcucucggugcaacuugauugccugggaucgaggggucuucauggc

SEQ ID NO: 57434 - RNA, 74 nt, Mycobacterium bovis subsp bovis AF2122/97
gcugcgccaaccagcgcuuggccggcagcgagaccugcagcugcagccgccgcugcgccagccgcuugcccagc

SEQ ID NO: 57435 - RNA, 102 nt, Mycobacterium bovis subsp bovis AF2122/97
gcugaucaacggcaguuugguuaaccccagccugcgcaagacggugacggcuguccugccgcacgccaagguuuugcgcgggcucaagaagcuaugauuugc

SEQ ID NO: 57436 - RNA, 85 nt, Mycobacterium bovis subsp bovis AF2122/97
gcuggcggaaggugaucaccgccaccuugucccugcgcugguaggcgucgcgcagcagcgacaggguggcgccacugaccgcagc

SEQ ID NO: 57437 - RNA, 57 nt, Mycobacterium bovis subsp bovis AF2122/97
gcugggccuuacgcaccugccgcucagcgacggccggcaggugcgcuaggucccggu

SEQ ID NO: 57438 - RNA, 84 nt, Mycobacterium bovis subsp bovis AF2122/97
gcgccgcggugcggcaccaugaugacgugcuuuagcuucggccguucgccggaggucgugguggugcucaacucgacgcggcgc

SEQ ID NO: 57439 - RNA, 62 nt, Mycobacterium bovis subsp bovis AF2122/97
gcgcgcggacgucgaugucgagcuguugggccaacgacagcugcugguuugagucugcgugc

SEQ ID NO: 57440 - RNA, 129 nt, Mycobacterium bovis subsp bovis AF2122/97
gcgcgcgguuggucacuuugcaccgaguggccugacuucucgacgaugugaacgccacggaaaugcguugcacgccuguggaguucggcgguguccuggucggugacgaagcccgacgagccgccgcgc

SEQ ID NO: 57441 - RNA, 69 nt, Mycobacterium bovis subsp bovis AF2122/97
gcggcguggaaugcaugaucgucgccaacgacccgacggucaagggcggcaccagcaauccguggacgc

SEQ ID NO: 57442 - RNA, 87 nt, Mycobacterium bovis subsp bovis AF2122/97
gcggcguuucugcgcggugucaacgucggcggcgucaaccucaagauggccgagguggcgacggcguugaccgaugcgggauucugc

SEQ ID NO: 57443 - RNA, 91 nt, Mycobacterium bovis subsp bovis AF2122/97
gcggcgccgauaccgccgagcacgccggcgcgguugcgcugcgaccacaaaucggcgcccagcgccagcgugaucggcaauagcgcgccgc

SEQ ID NO: 57444 - RNA, 79 nt, Mycobacterium bovis subsp bovis AF2122/97
gcggaucagcugguccagccgcagcgugcgcggcaccccgucgacgaucgcuagcauguuggcgccaaagcuggucugc

SEQ ID NO: 57445 - RNA, 85 nt, Mycobacterium bovis subsp bovis AF2122/97
gcggaucuggccuuggcaguccagccgggugccggcauagaucgggucguuggcggcggucggcugggcgaagcccagaucuugc

SEQ ID NO: 57446 - RNA, 104 nt, Mycobacterium bovis subsp bovis AF2122/97
gcggcccgucacuugcgccgaaggugaacucacggcgagguuucgcggcgcucgcgaauucaugcccucaguucacguucgacguucgugaucaacggugccgc

SEQ ID NO: 57447 - RNA, 60 nt, Mycobacterium bovis subsp bovis AF2122/97
gcggcaugcgcgaucugcagagcgcggccggucugcucgagcauguccagugcgugccgc

SEQ ID NO: 57448 - RNA, 68 nt, Mycobacterium bovis subsp bovis AF2122/97
gcguggggcucggccaguugcuccuggcgcuggaugcgaccguggucagccugguggacgccccgcgc

SEQ ID NO: 57449 - RNA, 98 nt, Mycobacterium bovis subsp bovis AF2122/97
gcgugccgggcccccuaccgucgauguggcgggaguaguucucgaugcccgagcagaacccgaccugccgcaucauuucgaugucguaguuggugcgc

SEQ ID NO: 57450 - RNA, 79 nt, Mycobacterium bovis subsp bovis AF2122/97
gcguaguggucggccaccagcuggacgccgucgcgcaucgggacucggacgugaccgacgguguagcgggugguugcgc

SEQ ID NO: 57451 - RNA, 67 nt, Mycobacterium bovis subsp bovis AF2122/97
gcgguugggcagacgcuggucaacgagggauucgagccucuuucgcaacagcagcugauccaacggu

SEQ ID NO: 57452 - RNA, 91 nt, Mycobacterium bovis subsp bovis AF2122/97
gcgguacacgucggcgcuugggaagguuacagcugguuggcguucggaaccaccaaugggauguugccgagcaucaccgacagugcgccgc

SEQ ID NO: 57453 - RNA, 77 nt, Mycobacterium bovis subsp bovis AF2122/97
gcgguccaaggucaacccggcggagucguguucgagcauguucugaagugccuugaauucgccccggccuggaucgc

SEQ ID NO: 57454 - RNA, 75 nt, Mycobacterium bovis subsp bovis AF2122/97
gcggggcccgccaacaaggugccguccggguuuaugacgccgucgccggccuugaccgccuugauggcggccugc

SEQ ID NO: 57455 - RNA, 59 nt, Mycobacterium bovis subsp bovis AF2122/97
gcgggucauccagcaguacgaggacgggccugcgggcccgaagcugcucgagaccgagc

SEQ ID NO: 57456 - RNA, 64 nt, Mycobacterium bovis subsp bovis AF2122/97
gcgggucgccgaggcgcggauuccgacucgucauggggaguuucgcgccaucggcuacaccagc

SEQ ID NO: 57457 - RNA, 60 nt, Mycobacterium bovis subsp bovis AF2122/97
gcgggucggcgucuccaguuucuauuucuugacauggaaaaacggcggccccgacccugc

SEQ ID NO: 57458 - RNA, 59 nt, Mycobacterium bovis subsp bovis AF2122/97
gcgggcugcagcgguaguacuuuggccuguucggcgcaucuccuauggcugcggcccgc

SEQ ID NO: 57459 - RNA, 70 nt, Mycobacterium bovis subsp bovis AF2122/97
gcgggcugcccaaucagcgcugcgaccaggucucggcuggcgugcaguucggugaugugggucagcgugc

SEQ ID NO: 57460 - RNA, 58 nt, Mycobacterium bovis subsp bovis AF2122/97
gcgcgcccgacgggcggugaucggaugccgcauccugaccgccucgauucgggcccgc

SEQ ID NO: 57461 - RNA, 58 nt, Mycobacterium bovis subsp bovis AF2122/97
gcgccgguggcaggcgugacagccgcggucagugcacgccucaaagccgaugaggcgc

SEQ ID NO: 57462 - RNA, 79 nt, Mycobacterium bovis subsp bovis AF2122/97
gcgccggcggucagcacgcaugugcgguggccgacgcccucggcauccgcacggugcugaucccaccaauggccggcgu

SEQ ID NO: 57463 - RNA, 58 nt, Mycobacterium bovis subsp bovis AF2122/97
gcgccagugcugcgcgugcacaauguuguuggcggucaaugcacuccaccgcuggcgc

SEQ ID NO: 57464 - RNA, 55 nt, Mycobacterium bovis subsp bovis AF2122/97
gcgccgccggggaucccgaccugcuggugucgcgggucgcggucugcggcggcgc

SEQ ID NO: 57465 - RNA, 63 nt, Mycobacterium bovis subsp bovis AF2122/97
gcgauuugugcuuucagcuugucucgacgcugggaaugugucacgacccuugacgguacucgc

SEQ ID NO: 57466 - RNA, 65 nt, Mycobacterium bovis subsp bovis AF2122/97
gcgccaccaugcgcgccuacgcgaaacuacuaggcuguucugcgacaugagugcauggcgggcgc

SEQ ID NO: 57467 - RNA, 60 nt, Mycobacterium bovis subsp bovis AF2122/97
gcgagaugucagcagaucggcuauacgagcgguugcugggcuggcuugccgacauucagc

SEQ ID NO: 57468 - RNA, 58 nt, Mycobacterium bovis subsp bovis AF2122/97
gcgagcagacgcaaaaucgcccgaaagccaucgguuucgggcgauuuugcguccucgu

SEQ ID NO: 57469 - RNA, 64 nt, Mycobacterium bovis subsp bovis AF2122/97
gcgauaucgguggccagcgaggcgccggcaaccagcucgcgagucugaccgcugaaccggucgc

SEQ ID NO: 57470 - RNA, 57 nt, Mycobacterium bovis subsp bovis AF2122/97
gcgacagugaugcccagucugcugcugaaccggaggcagagccgaucguccuguugc

SEQ ID NO: 57471 - RNA, 71 nt, Mycobacterium bovis subsp bovis AF2122/97
gcgaccagucagagucucgggcauguacguaauguagacguacuucgucgacgucugaucgguguugaugc

SEQ ID NO: 57472 - RNA, 83 nt, Mycobacterium bovis subsp bovis AF2122/97
gcgaccgauggugguuugguugccuaccgcgugggcgcgcaccaccacgcguccgcgcaccacgaccgaaccggcgugcacgc

SEQ ID NO: 57473 - RNA, 97 nt, Mycobacterium bovis subsp bovis AF2122/97
gcgaacuccgcguuaucggacaggucggcaccaccaucgggcucggucuacuuuucgauacccuggugguccgaucguucaugacgccauccaucgc

SEQ ID NO: 57474 - RNA, 62 nt, Mycobacterium bovis subsp bovis AF2122/97
gccuggaggaccuggacucggcgcugaaggaaaccagccagcugaaccugauccucaagggc

SEQ ID NO: 57475 - RNA, 130 nt, Mycobacterium bovis subsp bovis AF2122/97
gccuggauccugccggucggccuucccggcgaccuggguucgacccaguccaagcaggcguacgcccgcgucgcugacaucgucgaacaccaggucgcaggcucgacacugacggcuaaccugaccgggc

SEQ ID NO: 57476 - RNA, 91 nt, Mycobacterium bovis subsp bovis AF2122/97
gccuguccgaugaucgcgaguuuguccagcgucugcuuggcacggaucuccuggaccaugccgaugacgcuguuggcgaugaugagcaggc

SEQ ID NO: 57477 - RNA, 72 nt, Mycobacterium bovis subsp bovis AF2122/97
gccugggguucgacggggaucucagacuuggggggauugggaggugaugagacccccgucgaagucuagugc

SEQ ID NO: 57478 - RNA, 74 nt, Mycobacterium bovis subsp bovis AF2122/97
gccguuccggugguggucuccagcgcgcucgauuccgccgucggaaucgccgccggccugaccgccgccgcggc

SEQ ID NO: 57479 - RNA, 63 nt, Mycobacterium bovis subsp bovis AF2122/97
gccugguguccgagcggcccuucaccagccaccccugcgguccgcugccaucggcaccagcgc

SEQ ID NO: 57480 - RNA, 62 nt, Mycobacterium bovis subsp bovis AF2122/97
uacccgcaucuguuggcgcucucggccucaucacccuggugggguggcgaagacaccgggua

SEQ ID NO: 57481 - RNA, 56 nt, Mycobacterium bovis subsp bovis AF2122/97
guuuuccucggugcgggcgcgcuggaagccgaguugcgccaccgccagaggauaac

SEQ ID NO: 57482 - RNA, 84 nt, Mycobacterium bovis subsp bovis AF2122/97
guuggcggugguuucguggccggcgagcaugaacgucagagcuucaucgcguacucgcuggcggggccagauuccgccgucggc

SEQ ID NO: 57483 - RNA, 111 nt, Mycobacterium bovis subsp bovis AF2122/97
guuggguugccaagauuuuccguguuggccggguggucgagcccgcggcccccuuaccggcggcgauagccgaaccacccgccgggguacgggguucgcugcagauccgac

SEQ ID NO: 57484 - RNA, 78 nt, Mycobacterium bovis subsp bovis AF2122/97
guuguguugaucaccaccggcacccaaggcgagccgaugucggcguugucgcgaaugucgcguggggagcaucgcagc

SEQ ID NO: 57485 - RNA, 58 nt, Mycobacterium bovis subsp bovis AF2122/97
guugugaagacgccauucgcagaguuagcaagcgugcugcgauugguguuuccgccac

SEQ ID NO: 57486 - RNA, 69 nt, Mycobacterium bovis subsp bovis AF2122/97
ucaccggccgguugugcccggcuccgugcgagccggcgugugugcugggcaucaaccaggauccgguga

SEQ ID NO: 57487 - RNA, 85 nt, Mycobacterium bovis subsp bovis AF2122/97
uagucagauucgcgagccgccaccgcuaccacccgugcugcucgagguguggccggugaucgcggucggcgcgcucgccuggcug

SEQ ID NO: 57488 - RNA, 121 nt, Mycobacterium bovis subsp bovis AF2122/97
uaucggaaggggcaaggcuaguuuugcgagaauuccguugcgccuauuugaaagcccgacaugaaacgaucgcuuuuaagcgcauaugucuguucugcaaaaaugucuaauuuuuccgaua

SEQ ID NO: 57489 - RNA, 70 nt, Mycobacterium bovis subsp bovis AF2122/97
uagcuugucgaccgugcggucgaauuccguuugaugcuugacggugguggccagcacgguguucaaguug

SEQ ID NO: 57490 - RNA, 56 nt, Mycobacterium bovis subsp bovis AF2122/97
uagcgggccauggacuggucgucgaacacguugucaccgcuuccauggcguuguua

SEQ ID NO: 57491 - RNA, 77 nt, Mycobacterium bovis subsp bovis AF2122/97
uccucgaccgcgcagcgugaucaccgaaccuggcugcgugccggguggaauggugaucucgcucaggccguccagga

SEQ ID NO: 57492 - RNA, 57 nt, Mycobacterium bovis subsp bovis AF2122/97
ucgaacgugaacggcuggaguccaagaagaucuccaagacccaggccgucacuucga

SEQ ID NO: 57493 - RNA, 88 nt, Mycobacterium bovis subsp bovis AF2122/97
uccccgacgguguguagcccaccggugcuguaggcgaaggugcaggcaaagaucgccagcaccaccugguugggcacaucgcgcagga

SEQ ID NO: 57494 - RNA, 117 nt, Mycobacterium bovis subsp bovis AF2122/97
uccggcgaguacugcaccaugccgaacggcaccgaggcgccgggaaaguuguugaucucccccacuaucgcggcucccgugccggugccgaugagcguauugacaugcucgaccgga

SEQ ID NO: 57495 - RNA, 68 nt, Mycobacterium bovis subsp bovis AF2122/97
uccagcuaaacccaaagccuugcaugaggcaaaggcggccguucaugaccuggcgggucgugguugga

SEQ ID NO: 57496 - RNA, 58 nt, Mycobacterium bovis subsp bovis AF2122/97
uccagcacugucuuggcuucggcgccaaauuccguugcgccggagcugacguacugga

SEQ ID NO: 57497 - RNA, 57 nt, Mycobacterium bovis subsp bovis AF2122/97
ucaccugcccggcaccuggagcgcgcugcgaucagccggugaagccggguuugguga

SEQ ID NO: 57498 - RNA, 99 nt, Mycobacterium bovis subsp bovis AF2122/97
ucagccacuugcgauacaacguguuccaggugccgucauugcggaugcguucgagcgugccguugacgaaccggaccaauccgguguuguccagguuga

SEQ ID NO: 57499 - RNA, 69 nt, Mycobacterium bovis subsp bovis AF2122/97
ucagcgagaagccuuguggugcgcccauuuccaucggugaacggauggauucgcacaaggucugcauga

SEQ ID NO: 57500 - RNA, 72 nt, Mycobacterium bovis subsp bovis AF2122/97
ucgacccaccgugguguccggcggccgcuugcucgucgguggcccacugcaaccggaccucgcgggagucga

SEQ ID NO: 57501 - RNA, 60 nt, Mycobacterium bovis subsp bovis AF2122/97
ucgagcucacccaggguggccgcacagcggugcacgccguggucacccugggugagccgg

SEQ ID NO: 57502 - RNA, 55 nt, Mycobacterium bovis subsp bovis AF2122/97
ucgaggacggugucgagccccgcgacgucuggcgggcauugugcgccgacuucga

SEQ ID NO: 57503 - RNA, 89 nt, Mycobacterium bovis subsp bovis AF2122/97
ucgcgacccaggccaccgcgcggccaccgacguucguguuguucaccacggguuuuuuggaggccggcuaucggcgguucuuggagcgg

SEQ ID NO: 57504 - RNA, 64 nt, Mycobacterium bovis subsp bovis AF2122/97
ucgcgcgucugcguugagaccagcaucccacgaucguggggguuggugauguagccgauaucga

SEQ ID NO: 57505 - RNA, 86 nt, Mycobacterium bovis subsp bovis AF2122/97
ucgcgguugcugaaaccauuagccuuaugccugucacaccaccgcgguuggcggggugaggagucgggcgauggauggcaccgcgg

SEQ ID NO: 57506 - RNA, 57 nt, Mycobacterium bovis subsp bovis AF2122/97
ucgcguuguuggccaacuugggcccguugaccuggccugggauggucaacaccguga

SEQ ID NO: 57507 - RNA, 70 nt, Mycobacterium bovis subsp bovis AF2122/97
ucgcuacgacagcgacuugggcgcgcggcuggcggucgcgcacgcccuugcgcugcaauucgguuggcgg

SEQ ID NO: 57508 - RNA, 89 nt, Mycobacterium bovis subsp bovis AF2122/97
ucgcucucggcgcugucguuggccaaccugcugcacgagaucuucggcgucgacgugccggugggugucauugucagcccggcaagcga

SEQ ID NO: 57509 - RNA, 70 nt, Mycobacterium bovis subsp bovis AF2122/97
ucggacggcaccaagucaccggcauccaaguagcguuuggcuuccacgccgagcuuggugcccucuucga

SEQ ID NO: 57510 - RNA, 85 nt, Mycobacterium bovis subsp bovis AF2122/97
ucggaaguccaccgcucugccgagucccguuguaccgccccaggcaaaugccucagcguugcggcggguacugcgacgggcccga

SEQ ID NO: 57511 - RNA, 71 nt, Mycobacterium bovis subsp bovis AF2122/97
ucgcugcggggugggcuggugcuagggcuggaggauuccagcucccggaugagccggcucggccgcagcga

SEQ ID NO: 57512 - RNA, 113 nt, Mycobacterium bovis subsp bovis AF2122/97
ucggugcuggugucgugggugcuguucaccuggaugauuggccggcugccgcgggagccggucgguuuggucaccgcggcgcgggccggguugauggcggcggucggcuucga

SEQ ID NO: 57513 - RNA, 55 nt, Mycobacterium bovis subsp bovis AF2122/97
ucgggguggugcaggauggcgucgacggccuccuugucgccgugcaccaccugga

SEQ ID NO: 57514 - RNA, 86 nt, Mycobacterium bovis subsp bovis AF2122/97
ucggucgccgccgcgucgccggucucccagucgaagaugugauugucgcucuuucccuccagaucggugcggaugaccggcgccga

SEQ ID NO: 57515 - RNA, 72 nt, Mycobacterium bovis subsp bovis AF2122/97
ucggcgaagggcuggaccgcgaggagcugcaaccacgguugccggcggucauggaccggcuugaucgcgcga

SEQ ID NO: 57516 - RNA, 70 nt, Mycobacterium bovis subsp bovis AF2122/97
ucggccagcugcgcggcuauccggcccaucggggcccgcuugcccgggucacgaucgccgccggcgccga

SEQ ID NO: 57517 - RNA, 119 nt, Mycobacterium bovis subsp bovis AF2122/97
ucgucaucuccgcacgcgcggaacccauccgccgccugcucggcggccugaaugaaacgguguucaggcuacgguagcggugcgcacggggacaaacgcgacgugggcggaggucacgg

SEQ ID NO: 57518 - RNA, 79 nt, Mycobacterium bovis subsp bovis AF2122/97
ucggcgcgcacauugaaaccgaugaucaccgcaucggaagccgacgccagguugacguugguuucgguaaugccgccga

SEQ ID NO: 57519 - RNA, 75 nt, Mycobacterium bovis subsp bovis AF2122/97
ucuaccggcaaggcagggaggaauucgacaccgaacucggaccggugguggccaacuuccugcucgccgacgaga

SEQ ID NO: 57520 - RNA, 57 nt, Mycobacterium bovis subsp bovis AF2122/97
ucgucgggagcuaugcguccgaaguccuugugcucgggcagcaggaugcgccugcga

SEQ ID NO: 57521 - RNA, 94 nt, Mycobacterium bovis subsp bovis AF2122/97
ucuagcaccgccacccggucgcugagcacccuggccagcaccuugcgugccaccgccagcagcucggcgauaucgggugcggcaaucgaauaga

SEQ ID NO: 57522 - RNA, 69 nt, Mycobacterium bovis subsp bovis AF2122/97
ugaucugcacggccaaaggcaucgccgauggauugccgcugucggcggucaccggccgcgccgagauca

SEQ ID NO: 57523 - RNA, 72 nt, Mycobacterium bovis subsp bovis AF2122/97
ugaugaagccgccuuggacgacgguuccgaugcuggagaacagcaggccggacaucgaagcggcaaauauca

SEQ ID NO: 57524 - RNA, 60 nt, Mycobacterium bovis subsp bovis AF2122/97
ugaaggucuugugcccguugaggauguagucuucaccgucgcgggucacgugagucuuca

SEQ ID NO: 57525 - RNA, 78 nt, Mycobacterium bovis subsp bovis AF2122/97
ugcacgccagcgucccggguugcuggccgcuuggcuggacggcgaccucggcgagcugcccggcgacuuggccuggca

SEQ ID NO: 57526 - RNA, 60 nt, Mycobacterium bovis subsp bovis AF2122/97
ugcaauguuucgacgggcaccaaauccggauuuccguuugacuccacgcgaaacacagua

SEQ ID NO: 57527 - RNA, 84 nt, Mycobacterium bovis subsp bovis AF2122/97
ugcaggugcacuacgucggugauuugguugcggcgcaccaacguucgaagcaucgacauuaccggcguaauccccgacccggca

SEQ ID NO: 57528 - RNA, 80 nt, Mycobacterium bovis subsp bovis AF2122/97
ugccgacaucggccgccagcucucggcgcuggccgacgccuacgacgucaagcugccccgcgagcuggugcugaucggca

SEQ ID NO: 57529 - RNA, 68 nt, Mycobacterium bovis subsp bovis AF2122/97
ugccgcccggugaggaccuggccgcgcucgcccgaucccgcgccacucuggucuugcaccuggccgca

SEQ ID NO: 57530 - RNA, 63 nt, Mycobacterium bovis subsp bovis AF2122/97
ugcgaccucaccagcggcuuucgagcuuuguucgaucaaccggccagcauggucgaggaugca

SEQ ID NO: 57531 - RNA, 64 nt, Mycobacterium bovis subsp bovis AF2122/97
ugcgccacuggggucaccgacggcgaccugcucaagggagugcguuacuaccccggcggcugca

SEQ ID NO: 57532 - RNA, 130 nt, Mycobacterium bovis subsp bovis AF2122/97
ugcgccagcgcggcgagaucacccgcgcgggggucaccggccuggugcucaauagcccguuccuggaucugcaaggcccggcaauccugcgccugccgcugaccucggcguucuucgccgcgauggcgcg

SEQ ID NO: 57533 - RNA, 69 nt, Mycobacterium bovis subsp bovis AF2122/97
ugcgcccggguuugaccacgaugcugaacgucacguccagcguugucucggcgaacaccugcaggcgca

SEQ ID NO: 57534 - RNA, 57 nt, Mycobacterium bovis subsp bovis AF2122/97
ugcuggccgcgcuggcgugggugugcgccgaugccauccugcuggugcggaccggca

SEQ ID NO: 57535 - RNA, 64 nt, Mycobacterium bovis subsp bovis AF2122/97
ugcugucggugcccgucuucagccgggacacuuacucguaucuggcccaaggggcgcuucugcg

SEQ ID NO: 57536 - RNA, 55 nt, Mycobacterium bovis subsp bovis AF2122/97
ugcuccggcacguuggucgagauugacgcauaggcucuggccaaggugucgagca

SEQ ID NO: 57537 - RNA, 93 nt, Mycobacterium bovis subsp bovis AF2122/97
ugcggcucaggcccgcgaacggcucggcuuugugaugccuggagacaucccguuucagguccagcuuccgucgacgccguuggcgccgccgca

SEQ ID NO: 57538 - RNA, 130 nt, Mycobacterium bovis subsp bovis AF2122/97
ugcgcuaccaccgcaccggggucgggaugucgaggacugggcauggcagcaggcccgucccgccggccacgacgguggggcuggcucugcuugccgcggcgauuacucucuggcuugguuugguggcgca

SEQ ID NO: 57539 - RNA, 57 nt, Mycobacterium bovis subsp bovis AF2122/97
ugggcaugaucuguggaucaggaacccgauacgggauuccacgguuuaucgugccca

SEQ ID NO: 57540 - RNA, 61 nt, Mycobacterium bovis subsp bovis AF2122/97
uggccggacugggugcggcgguggcccacgccgucggccaccgccacggccagcaccgccg

SEQ ID NO: 57541 - RNA, 55 nt, Mycobacterium bovis subsp bovis AF2122/97
ugggcugaacaggacggccgccaguggaggauaggugaacgggagguucagcccg

SEQ ID NO: 57542 - RNA, 68 nt, Mycobacterium bovis subsp bovis AF2122/97
uggcuguugucuugcucgcuuuggcuggcgcuuccuuugcggcagccggcuugucgggcaccggcgca

SEQ ID NO: 57543 - RNA, 57 nt, Mycobacterium bovis subsp bovis AF2122/97
uggcugggcgaccgcggugucggugaucuccucggucgaggcgguggugcccagccg

SEQ ID NO: 57544 - RNA, 57 nt, Mycobacterium bovis subsp bovis AF2122/97
uggcgccgcuacggggcggguauaucgcagauaucacgccucucggugguggggcca

SEQ ID NO: 57545 - RNA, 104 nt, Mycobacterium bovis subsp bovis AF2122/97
ugguuugagcagcgcgauagggaauucggguuuccagaaccucggcucgcugcagucaggcugggcgaaccugggcaacuccguaucgggcuuuuucaacacca

SEQ ID NO: 57546 - RNA, 107 nt, Mycobacterium bovis subsp bovis AF2122/97
uggucaggccggcgccgcuggcggcgccggguugggcuucggagcggucgggcacccgacuccucagccggcggcccugggcgcggcuggcgugguggccaagaccg

SEQ ID NO: 57547 - RNA, 61 nt, Mycobacterium bovis subsp bovis AF2122/97
ugguaggcgccaccggcguguuccucgcuugucgcugggcacaggccgauggcgcugacca

SEQ ID NO: 57548 - RNA, 103 nt, Mycobacterium bovis subsp bovis AF2122/97
uggugaaacagcccaagaagaagaacacggccgccgcugccacggcggcuauugucacuguuuuggcccggcugcgcgucgugucaucggaggggagucgcca

SEQ ID NO: 57549 - RNA, 62 nt, Mycobacterium bovis subsp bovis AF2122/97
uguugaucucacccgaaguuguguccgccgccgccggggaucuagcgaacgugggaucgaca

SEQ ID NO: 57550 - RNA, 71 nt, Mycobacterium bovis subsp bovis AF2122/97
uguccggugggcacaguuuugccgccagccaucugcgcgauggcgcugugcugcucgacgugagccggaua

SEQ ID NO: 57551 - RNA, 56 nt, Mycobacterium bovis subsp bovis AF2122/97
ugucugagagccccggaaagcgcucgccuaggccgcaggagcgcggcucauaggca

SEQ ID NO: 57552 - RNA, 57 nt, Mycobacterium bovis subsp bovis AF2122/97
ugguggcugugucgaccgggaacggcaacuacgccgugaucguugauacagcgacca

SEQ ID NO: 57553 - RNA, 59 nt, Mycobacterium bovis subsp bovis AF2122/97
uucaugcugugugaaccgggauagaccgcguagccgucccaggugccauacgagcugaa

SEQ ID NO: 57554 - RNA, 102 nt, Mycobacterium bovis subsp bovis AF2122/97
uuccgagcuucaucccugaggacuucaccuuccuugacgccauauucgcuggauaugccacgguaggugugacgcaggaugucgaguccuuuguugccggga

SEQ ID NO: 57555 - RNA, 58 nt, Mycobacterium bovis subsp bovis AF2122/97
guaccgcggaaagucggcgacgccgucguauucgaugguguagaucuuggucggguac

SEQ ID NO: 57556 - RNA, 100 nt, Mycobacterium bovis subsp bovis AF2122/97
guagcgugcccaguagaccucacgccggcgugcaucggugaccaccagcgugucaccgaugguuugcccgccgauggcguccaggcugcacacgccauac

SEQ ID NO: 57557 - RNA, 76 nt, Mycobacterium bovis subsp bovis AF2122/97
guagcccgccgagcagacgcaaaaucgcccauuucgugccgaaaugaggcgauuuugcgucugcucgccgggcuac

SEQ ID NO: 57558 - RNA, 58 nt, Mycobacterium bovis subsp bovis AF2122/97
guaugggucgauucggcggugcccaucggugaugugguggcgcaauucgaccaggugc

SEQ ID NO: 57559 - RNA, 70 nt, Mycobacterium bovis subsp bovis AF2122/97
guccaagcaggcgaucggccgggcgacgaacaacgucgccgaauaccgcggccugauagccgguuuggac

SEQ ID NO: 57560 - RNA, 56 nt, Mycobacterium bovis subsp bovis AF2122/97
gucacccgccugugcggguggacguaugcccuuuccgucguccugcugugggugac

SEQ ID NO: 57561 - RNA, 65 nt, Mycobacterium bovis subsp bovis AF2122/97
gucacgagcguaaccccagugcgaaaguucccgccggaaaucgcagccacguuacgcucguggac

SEQ ID NO: 57562 - RNA, 70 nt, Mycobacterium bovis subsp bovis AF2122/97
gucacguucccuguacgcgugccgcccgacuugguuugccaggucaccgagaugacgucaccgggaugau

SEQ ID NO: 57563 - RNA, 89 nt, Mycobacterium bovis subsp bovis AF2122/97
guauuuggagccggcgaccaucgagccgagaucgagcgcgacgauggucuugucgcgcaagcucuccggcacgucgccggccacgaugc

SEQ ID NO: 57564 - RNA, 69 nt, Mycobacterium bovis subsp bovis AF2122/97
gucgacgucgaagacgaucaggcguuuggugcgccaagccaagccguaguccucgacggccacaucgac

SEQ ID NO: 57565 - RNA, 92 nt, Mycobacterium bovis subsp bovis AF2122/97
gucccggugcgggguucggccaguucguggcgaccaugcgccgguugcaggaccuggcggucgcggcggaccccggcgacgccgugugggac

SEQ ID NO: 57566 - RNA, 67 nt, Mycobacterium bovis subsp bovis AF2122/97
guccguaccggcugggcagcgcaucguugacgauuugauccagcauggccucccggccgaugcgggc

SEQ ID NO: 57567 - RNA, 122 nt, Mycobacterium bovis subsp bovis AF2122/97
guccgaggacggcaggagcggccgggcucgcuggguggugggaaccgcuccagggcgggccaucccguucggcgcuuuccgccauuugaucagccugcccgccuccggagccgacauugggc

SEQ ID NO: 57568 - RNA, 93 nt, Mycobacterium bovis subsp bovis AF2122/97
guccgcggagaacguugucaugugcauggugaccgggugccgcucgaugagcgcacgugcggucaccaucucgcagacauacaguccgcugac

SEQ ID NO: 57569 - RNA, 102 nt, Mycobacterium bovis subsp bovis AF2122/97
ggucgguggggaugaggcguggguugugaacggaaccgccgggacuguaugagucugugcgcgguuugugcacagcgacacucacagccaaucucugugacu

SEQ ID NO: 57570 - RNA, 67 nt, Mycobacterium bovis subsp bovis AF2122/97
ggucgccucccgggcugggcugguuauggaagcuggauccaaagucaccuacaacgggguggagauc

SEQ ID NO: 57571 - RNA, 87 nt, Mycobacterium bovis subsp bovis AF2122/97
ggugaucggaugcguuggcagcgugaaguguucgggcggcaccgucgggccgcucgggggccgcgucgccaguggcgucgugauccc

SEQ ID NO: 57572 - RNA, 57 nt, Mycobacterium bovis subsp bovis AF2122/97
ggugauccggggcacgucgaggcuguagaacaggcugaacaggcccucgugaucacc

SEQ ID NO: 57573 - RNA, 68 nt, Mycobacterium bovis subsp bovis AF2122/97
ggugcgcggcagcgcccgggucaccagccccgaaccggaggcgaccuaucaggcgcugcagaaguacu

SEQ ID NO: 57574 - RNA, 63 nt, Mycobacterium bovis subsp bovis AF2122/97
gguugcgcugcgagcggcuuaaccgaacucggugcacacagccuccagcucgcgaagccaacc

SEQ ID NO: 57575 - RNA, 80 nt, Mycobacterium bovis subsp bovis AF2122/97
gguugacguaccgcggccggucggccaucaccuuacgcagcgaccccgcgcccggccgcuggucgcguacuagcucaucc

SEQ ID NO: 57576 - RNA, 60 nt, Mycobacterium bovis subsp bovis AF2122/97
gguuuggcgcgcccacagcccgggcggaaagcccgucgggccgucgggugugcgcagauu

SEQ ID NO: 57577 - RNA, 78 nt, Mycobacterium bovis subsp bovis AF2122/97
gguugugcuguuuugggccucggcgagccgacacgccucggcguucucagcuaagcgcugccuaaaccaugccuaacc

SEQ ID NO: 57578 - RNA, 70 nt, Mycobacterium bovis subsp bovis AF2122/97
gguguugggucagggcuucgaccgagaugugcugcugcgugcgggcauccagggggccgacgcauucgcc

SEQ ID NO: 57579 - RNA, 56 nt, Mycobacterium bovis subsp bovis AF2122/97
gguguaggucguugccgaccucgauccgcccgcugaacucggucgcggccagcgcc

SEQ ID NO: 57580 - RNA, 79 nt, Mycobacterium bovis subsp bovis AF2122/97
gguguauguggcgcugacacuccccucgggaucggggcccaccgcgauccaggaauugucagacguuaucgaccacacc

SEQ ID NO: 57581 - RNA, 82 nt, Mycobacterium bovis subsp bovis AF2122/97
ggugucggggugguagcggcgcuuggcggugucgggcagauugucaucgaucaccaccgagaugccgaaccggucccgcauc

SEQ ID NO: 57582 - RNA, 59 nt, Mycobacterium bovis subsp bovis AF2122/97
ggugguggcccgugaccguacccaggcgauagccggauugcgugcgcuggccgccggcc

SEQ ID NO: 57583 - RNA, 64 nt, Mycobacterium bovis subsp bovis AF2122/97
ggugggcaggugauccucgccggcgucgagcagacccaggcuggccaguucgcccugaccuacc

SEQ ID NO: 57584 - RNA, 76 nt, Mycobacterium bovis subsp bovis AF2122/97
guugaucgcacccgcucguaggaaggcgccggcgagggugggaccuccuuccagcagcacgucggugcgauccgac

SEQ ID NO: 57585 - RNA, 100 nt, Mycobacterium bovis subsp bovis AF2122/97
guucgucgucgucgcgaucaccaucgcuggcgcuucgcugucgaugcgcauuccgcgcugggucgaggugaccagcggugaggucccggccacauugagc

SEQ ID NO: 57586 - RNA, 63 nt, Mycobacterium bovis subsp bovis AF2122/97
guucgcgccaguguccgccgccgagccagguaagcagccccucgauuccggacacggccgagc

SEQ ID NO: 57587 - RNA, 87 nt, Mycobacterium bovis subsp bovis AF2122/97
guggccgcaccgaaguccgggcuguaguacugauccucauacgacgggaugguguacgccgcagcgcgggccuccucggugggcugc

SEQ ID NO: 57588 - RNA, 95 nt, Mycobacterium bovis subsp bovis AF2122/97
gugucucccgcggcgauggcggccugcaccggcgccgcgccacgccaggccggcagcagcgagaagugcagguugacccagccaugcggcggcac

SEQ ID NO: 57589 - RNA, 68 nt, Mycobacterium bovis subsp bovis AF2122/97
guguccagcagcccggucugguguccaacgcucaccaggaucgccaaaccggcgcugucgauggccgc

SEQ ID NO: 57590 - RNA, 56 nt, Mycobacterium bovis subsp bovis AF2122/97
gugguggccguggccgcgucguugaucugguggaccagcgacgcccgcgccaccau

SEQ ID NO: 57591 - RNA, 65 nt, Mycobacterium bovis subsp bovis AF2122/97
guggucaccgucgccgcaaucgagagccgguccgcgcccugcggcucgagcgugacggugaccgc

SEQ ID NO: 57592 - RNA, 78 nt, Mycobacterium bovis subsp bovis AF2122/97
gugguguccaugcccaacucggccagaauguuggcaacggccaacgggugggugauguagggaucaccggacugccgc

SEQ ID NO: 57593 - RNA, 63 nt, Mycobacterium bovis subsp bovis AF2122/97
guguauggcguguucacccccggcuacgucgacgccggcaagguggcgcacaucgccgugcac

SEQ ID NO: 57594 - RNA, 126 nt, Mycobacterium bovis subsp bovis AF2122/97
gucgguccgugccaaccugcacuucuuguggcugcggcuggccaggguguggccgguguaccuggucaccuugcaccuggccgccgugugggucaucuuuacgcugcacgucggucacgugccguc

SEQ ID NO: 57595 - RNA, 63 nt, Mycobacterium bovis subsp bovis AF2122/97
gucgccggggcgggucagggccugcacgacgaucuuguuggcggucgauguuccguuggugac

SEQ ID NO: 57596 - RNA, 60 nt, Mycobacterium bovis subsp bovis AF2122/97
gucgcggacagucccauguuagcugcauguuuagcagacuggcuugccuccugccgcgac

SEQ ID NO: 57597 - RNA, 63 nt, Mycobacterium bovis subsp bovis AF2122/97
gucgcccgcggucugcaugacgaugggcggcaggccgcucaugucgccguagaccggggagau

SEQ ID NO: 57598 - RNA, 69 nt, Mycobacterium bovis subsp bovis AF2122/97
gucgcccuugaggaucagguucagcuggcugguuuccuucagcgccgaguccagguccuccaggcugau

SEQ ID NO: 57599 - RNA, 63 nt, Mycobacterium bovis subsp bovis AF2122/97
gucgagcucccggugagacgagagucgggccaaagcuccaucgcgggucaacgggucgcucgc

SEQ ID NO: 57600 - RNA, 72 nt, Mycobacterium bovis subsp bovis AF2122/97
gucguggugcaccugccgaucgcacagguuggcccacaaccggccgcuugaugcccggucggcaagcccggc

SEQ ID NO: 57601 - RNA, 63 nt, Mycobacterium bovis subsp bovis AF2122/97
gugaucgauguugaccgagaugccgccgaggucgaucuugucgccgucucgguccagcuccac

SEQ ID NO: 57602 - RNA, 77 nt, Mycobacterium bovis subsp bovis AF2122/97
gugaugcguucggccgggccguguccgccggauagcaccggcacccgcacggccuccggaccgagcaagcccugcac

SEQ ID NO: 57603 - RNA, 88 nt, Mycobacterium bovis subsp bovis AF2122/97
gugcuggcuugccuggcgagcagacgcaaaagccccuaauaccugccgguuuagggggcuuuugcgucugcucgccggccuaccgcgc

SEQ ID NO: 57604 - RNA, 78 nt, Mycobacterium bovis subsp bovis AF2122/97
gugcggcgucugcugcgugcacaauucccacagugggcggaucuacccauugcaccggugcgcucggcgggcacggac

SEQ ID NO: 57605 - RNA, 99 nt, Mycobacterium bovis subsp bovis AF2122/97
gugccgcacgccgagcguuguccgcauucgcagcgacgguaaaggacuugcgggccaauccuuuccgucgaugcggaagcgaacgaacgcuagcggcgc

SEQ ID NO: 57606 - RNA, 55 nt, Mycobacterium bovis subsp bovis AF2122/97
ggggucagcggucaccggcgauggcgaauggccaccaccgccuggcgcugacccc

SEQ ID NO: 57607 - RNA, 89 nt, Mycobacterium bovis subsp bovis AF2122/97
ggggugaccgccugguuggccgcggcccaugcuggcggcaccgacaacgaaccgaccgaggccgcccgacccaaguuggcggccacccc

SEQ ID NO: 57608 - RNA, 55 nt, Mycobacterium bovis subsp bovis AF2122/97
gggguggugaaguacacgcccggcucgucggcaaucaaggcgaacuucacccccu

SEQ ID NO: 57609 - RNA, 61 nt, Mycobacterium bovis subsp bovis AF2122/97
gggcgucgcuggugggaucgcagcgccauuccaagacguugcgcucgaucacuagcgcccc

SEQ ID NO: 57610 - RNA, 74 nt, Mycobacterium bovis subsp bovis AF2122/97
gggcgucguagguguggcccuccgacagcgccuucugaaagaucgacggguugguggucaccccgacgacgcuc

SEQ ID NO: 57611 - RNA, 87 nt, Mycobacterium bovis subsp bovis AF2122/97
gggcgcuggacuuaugcaagaccaggacggcgccgucgcggauaccgcauugcgccaaugucguugcguuuggcagagcuggcgccc

SEQ ID NO: 57612 - RNA, 89 nt, Mycobacterium bovis subsp bovis AF2122/97
gggcgaaccgccauggcagcucagccgcaagcaccgucagcgggcggccgcccgcgcgcggggaaagcggugaaguccguggcucgccc

SEQ ID NO: 57613 - RNA, 58 nt, Mycobacterium bovis subsp bovis AF2122/97
ggggauagccgcaggauggucuucaaguucaucucuucggggaucuuggggcugcccc

SEQ ID NO: 57614 - RNA, 80 nt, Mycobacterium bovis subsp bovis AF2122/97
ggggcaacaacaggguggugaaguuggcggccggauccaagacccagaccgugcugccguucaccggccucaacgacccc

SEQ ID NO: 57615 - RNA, 130 nt, Mycobacterium bovis subsp bovis AF2122/97
ggggccggaccggccggucaggcgcgcguacucgguauccagcaggccuucggcagugagccgguccaaauggaauuucgccugguggcgcgggaugccgacggcgucggccgccuggucucggcucacc

SEQ ID NO: 57616 - RNA, 129 nt, Mycobacterium bovis subsp bovis AF2122/97
gggcuggcggucgucauacuuuccggggucgcggcggcggccaacgaggcagcggcggcccuccucggcuucccgcugcugcucgugguuggggugucgcuggccuauuuguaugucguccugcuguuc

SEQ ID NO: 57617 - RNA, 85 nt, Mycobacterium bovis subsp bovis AF2122/97
gguaccgggcuccggugguuguggugguguaggucucgaugcgguaguagccgcgcucgcgagccgccgcacuggggccggugcc

SEQ ID NO: 57618 - RNA, 68 nt, Mycobacterium bovis subsp bovis AF2122/97
gguccgaaucgcgauguugucgaucauccaccgacccccgguggcguggucgccgauguccucaagcc

SEQ ID NO: 57619 - RNA, 65 nt, Mycobacterium bovis subsp bovis AF2122/97
gguccgacuagggcaaugccuguugcaauguuuguugagaugagccgaaauuacccugcgugacc

SEQ ID NO: 57620 - RNA, 63 nt, Mycobacterium bovis subsp bovis AF2122/97
ggucauugcgucauuuccuucgauugacuuuugcuggucguuucgaaggaucacgcgaugacc

SEQ ID NO: 57621 - RNA, 88 nt, Mycobacterium bovis subsp bovis AF2122/97
ggucauuggcgaucaaugcgaugcggucgucacggaccgccaccuuggcguugaccagcacgacugcaucgucgacgaugucggcacc

SEQ ID NO: 57622 - RNA, 114 nt, Mycobacterium bovis subsp bovis AF2122/97
ggcgucgccgggcauggcccgggccaaagacguccuggcgcaguacgcggcucaggcacgucacgagcuggccuuacugcccgacgucccgggacggcgugcccuggcggcgcu

SEQ ID NO: 57623 - RNA, 58 nt, Mycobacterium bovis subsp bovis AF2122/97
ggcggugaucgcagacgcguucgguaugcaucuggacagcuuucagcgaaucaccgcc

SEQ ID NO: 57624 - RNA, 73 nt, Mycobacterium bovis subsp bovis AF2122/97
ggcgggcaauccggccugugucgggucgucccagcacguaacggacggcccgacacgggcucggccgcuagcu

SEQ ID NO: 57625 - RNA, 73 nt, Mycobacterium bovis subsp bovis AF2122/97
ggcggcucagcaaauacuggagauagcuaaccuaacggauagguaaauaaauccguguuugccgauggucgcu

SEQ ID NO: 57626 - RNA, 79 nt, Mycobacterium bovis subsp bovis AF2122/97
ggcggccugcgcccuuaauggggugucaccuaccugcagguuuaucugcaccagcgucggcccaucggcgcaguucgcc

SEQ ID NO: 57627 - RNA, 74 nt, Mycobacterium bovis subsp bovis AF2122/97
ggcgcgggaaucauugcccggcuccuggcggccgcugucgccgggcgcggcgggcagaucugaggaggagcgcc

SEQ ID NO: 57628 - RNA, 66 nt, Mycobacterium bovis subsp bovis AF2122/97
ggcggcuuucaucaguuggucgagguugaccccggcgucgaugucgaccagcuuggugucggcguc

SEQ ID NO: 57629 - RNA, 69 nt, Mycobacterium bovis subsp bovis AF2122/97
ggcugcgcuggcccgccgguuucccgccgugauugcagcaccgcgucguaaagcuggcgggugcgcacc

SEQ ID NO: 57630 - RNA, 57 nt, Mycobacterium bovis subsp bovis AF2122/97
gggauccggaagcccuuguagcacaccgacauugguguggaauacgcugcuggucuu

SEQ ID NO: 57631 - RNA, 86 nt, Mycobacterium bovis subsp bovis AF2122/97
gggaguggccacccugggcuuaugugacgacccccagcgcccggcuucgccgcgcucgcaaucgucacggggccugccguccuccc

SEQ ID NO: 57632 - RNA, 71 nt, Mycobacterium bovis subsp bovis AF2122/97
gggcaucgugggccugagcagcgacgacacccgacgacgcgaggucguccgcgacuuggccgcuggugccc

SEQ ID NO: 57633 - RNA, 75 nt, Mycobacterium bovis subsp bovis AF2122/97
gggccauggaaacgcagguggugucaacgugggcuccggaaacgcgggcuuggccaacaccggcgauuucaacuc

SEQ ID NO: 57634 - RNA, 71 nt, Mycobacterium bovis subsp bovis AF2122/97
gggcaugucgguggccgcugccaugucgccgagcaaccgguggccggccucgguccaccccgacagauccc

SEQ ID NO: 57635 - RNA, 80 nt, Mycobacterium bovis subsp bovis AF2122/97
gggagcucgcgcggccgagccugcggauuaucaacgagggcacugauggaugaccugacgcggcuccggcgcgagcuucu

SEQ ID NO: 57636 - RNA, 67 nt, Mycobacterium bovis subsp bovis AF2122/97
gggccgcggcggcgacggcggcaacgccggccacggcggcgccgcccaauucuccggucgcggcgcc

SEQ ID NO: 57637 - RNA, 67 nt, Mycobacterium bovis subsp bovis AF2122/97
ggcuugggccaacacgugcgcggucgaauggcggaucacgcugcgaccgucgucgguguuggcggcc

SEQ ID NO: 57638 - RNA, 58 nt, Mycobacterium bovis subsp bovis AF2122/97
ggcgagcgaggcagccccgaugggggacgagaucggccccugggccgccucgcucacc

SEQ ID NO: 57639 - RNA, 68 nt, Mycobacterium bovis subsp bovis AF2122/97
ggcgagcggcagcgucgggcgguucaacgaacaccagccguucuagccgccccgggcgcagcagcgcc

SEQ ID NO: 57640 - RNA, 82 nt, Mycobacterium bovis subsp bovis AF2122/97
ggccugacaguccagcagcaacgccaagucgcccaggcgaucaagaacgcccgcgagauggcgcugcugcccuacccgggcc

SEQ ID NO: 57641 - RNA, 64 nt, Mycobacterium bovis subsp bovis AF2122/97
ggccugcgccugaucgcguugcugcgcgccgcguaaccgcagcuuggaggcgaucgcgcgggcc

SEQ ID NO: 57642 - RNA, 85 nt, Mycobacterium bovis subsp bovis AF2122/97
ggccgcacggcaugucgucgauguuccgcagcuucgucgccggccaguuggccacguugcgcgaauucacgcugugcuaugcgcc

SEQ ID NO: 57643 - RNA, 61 nt, Mycobacterium bovis subsp bovis AF2122/97
ggccgcauccccgucguagcgguccacgaugaucugcgcgagcgccuggaugcguuuggcc

SEQ ID NO: 57644 - RNA, 66 nt, Mycobacterium bovis subsp bovis AF2122/97
ggccgggaugacagcgaggugcacucggcgauucgguuugcuguuguggccgcugucgucgggguc

SEQ ID NO: 57645 - RNA, 55 nt, Mycobacterium bovis subsp bovis AF2122/97
ggccggcggacacgcuggcgaugaaggccuucagcagggugauguccagcccgcc

SEQ ID NO: 57646 - RNA, 108 nt, Mycobacterium bovis subsp bovis AF2122/97
ggccggcaauauaugucauggaucagccuggaggacgaggugcgggcgcugcaguucgcuaucgcgcagcccaaccuguccggcccggugaacuugaccgggccggcc

SEQ ID NO: 57647 - RNA, 79 nt, Mycobacterium bovis subsp bovis AF2122/97
ggcgaugauguccgucgggaaggugaucgccgcguccgcggcaacggucggaaucaccuuccucggcaugagauucgcc

SEQ ID NO: 57648 - RNA, 76 nt, Mycobacterium bovis subsp bovis AF2122/97
ggcgccccagggggcgugccgccgcagaugggccuccaccgcguccaggugcgccguggcaucgccuccaggcgcc

SEQ ID NO: 57649 - RNA, 78 nt, Mycobacterium bovis subsp bovis AF2122/97
ggcgccggaagccaagagcggauauccggccacuccgauggggguuuacagccuggacuccgcuuuuggcaccgcgcc

SEQ ID NO: 57650 - RNA, 91 nt, Mycobacterium bovis subsp bovis AF2122/97
ggcgccgucgguggcacggcgaccgcgggggcauuuucccggccgggcuugccgguggaguaccugcaggugccgucgccgucgaugggcc

SEQ ID NO: 57651 - RNA, 106 nt, Mycobacterium bovis subsp bovis AF2122/97
ggcgccgccgccgcgcccgcgcuuggucacguacggccgccgcggccgccgccgccgccgcacuaucgggcuguggugccuugcguugagcgcuggcgcuggcgcu

SEQ ID NO: 57652 - RNA, 117 nt, Mycobacterium bovis subsp bovis AF2122/97
ggcgccggugccgaaggugcccgcguuggccaacccgguguuggcaugcccgguguugaaccagccgguguugaugccgcccggguugaagccaccgguguuggugucgccggcguu

SEQ ID NO: 57653 - RNA, 76 nt, Mycobacterium bovis subsp bovis AF2122/97
ggcggagaauacaucggugucggcggcccgcucguguucagcggcaagcccguggugucgcaccggugccuucgcc

SEQ ID NO: 57654 - RNA, 127 nt, Mycobacterium bovis subsp bovis AF2122/97
ggcggcccgguucaccgcgcacaccaagcacuaccgaguggugaguaagccggccgcgcugguccauggcauguucguggcccucccggcggccaccgccgaugcguaugcgaccaccgaggccguc

SEQ ID NO: 57655 - RNA, 61 nt, Mycobacterium bovis subsp bovis AF2122/97
ggcggaucgggagcggcgguggucaacugugccaccaaguagcgcgacucccguugucguc

SEQ ID NO: 57656 - RNA, 65 nt, Mycobacterium bovis subsp bovis AF2122/97
ggaucuugcugguaugccgggccaccgaaaccaugggcaccgguggcagcggguccggcgacucc

SEQ ID NO: 57657 - RNA, 68 nt, Mycobacterium bovis subsp bovis AF2122/97
ggaucugggccacucguccggcgauggcgucggugucaccggcgcccucgacgaugguggucucgucc

SEQ ID NO: 57658 - RNA, 67 nt, Mycobacterium bovis subsp bovis AF2122/97
ggcccggcugccggcuacggcgcucccggcuacgaccagggcuaucgccaaagcggcggcugcggcc

SEQ ID NO: 57659 - RNA, 60 nt, Mycobacterium bovis subsp bovis AF2122/97
ggcaggacgcagaucagggccagcaagccggugcguccgguuaggaucaucugcgccgcu

SEQ ID NO: 57660 - RNA, 73 nt, Mycobacterium bovis subsp bovis AF2122/97
ggccacguuuuguccgaugcgguagaugucgagggccaaggcaucuaaaccgacgcgcacgagaucacgggcc

SEQ ID NO: 57661 - RNA, 66 nt, Mycobacterium bovis subsp bovis AF2122/97
ggcagagccagcgcacggaaauccacccacgacagguagguaccguccggagcguugaccucuacc

SEQ ID NO: 57662 - RNA, 75 nt, Mycobacterium bovis subsp bovis AF2122/97
ggcacgugacuauaucaccguuaucggagcgaucguguuaccgauucucuucauggugguguugaacauugugcu

SEQ ID NO: 57663 - RNA, 58 nt, Mycobacterium bovis subsp bovis AF2122/97
ggcagcagcgccaucucgcgggcguucuugaucgccugggcgacuuggcguugcugcu

SEQ ID NO: 57664 - RNA, 67 nt, Mycobacterium bovis subsp bovis AF2122/97
ggaugucggcugggcugaggucauggacagaggcaugcccgagacccaucagagccgagucgauacc

SEQ ID NO: 57665 - RNA, 93 nt, Mycobacterium bovis subsp bovis AF2122/97
uuggucgcuuucauucguugcgcgcagaccggucuuuguaugacgaugaugggaaguucuaucugccgccaaaagcagaauggcaggacgcag

SEQ ID NO: 57666 - RNA, 59 nt, Mycobacterium bovis subsp bovis AF2122/97
uugcugcugcuggccggccagcccgaggaguccuuggcuggucggaccgucagcgacga

SEQ ID NO: 57667 - RNA, 119 nt, Mycobacterium bovis subsp bovis AF2122/97
uugcaaucggacauggaccuaagugucuaagcugcgccagccacgccgucggaccuaucagcuaauucggcgcgcgucgcggcgcacuauucccgcgcgagggucuggccgggucgcgg

SEQ ID NO: 57668 - RNA, 62 nt, Mycobacterium leprae
uugccgcauugacuacgcuggcggauccagucuacuccgcaaauggcguucauaaugggugg

SEQ ID NO: 57669 - RNA, 100 nt, Mycobacterium leprae
uugacgagagcgcggugcugucgauguggauuacgacaucgacuccaucaccgaggauguucagaucggcaucgguuacuagggcugcgaucucgaucaa

SEQ ID NO: 57670 - RNA, 57 nt, Mycobacterium leprae
uuuugugcagcguguugauccaguuccauuuuggggugucuugacuguuggacagga

SEQ ID NO: 57671 - RNA, 75 nt, Mycobacterium leprae
ggccgcgacaagcuguguccgucggcagacuggaccgccucaccaccaagaucaccgauccacagcgacgccgcc

SEQ ID NO: 57672 - RNA, 57 nt, Mycobacterium leprae
gggagcucaaguucuuuggcuaacaauuuaagauggcgggagaacuccgagacuucc

SEQ ID NO: 57673 - RNA, 75 nt, Mycobacterium leprae
ggcgugacgaccugcaggucguuaucgcgaugcugaagaacgccggccgugaugucgcuuugcaguucguccgcu

SEQ ID NO: 57674 - RNA, 80 nt, Mycobacterium leprae
ggcguugucgcccuugaggaucagguucagcuggcugguuuccuucagcgccgaauccagguccuccaggcugauucgcu

SEQ ID NO: 57675 - RNA, 70 nt, Mycobacterium leprae
gguaaugauugcguaacaaccacuuccauaauccauaaccgguaagaaacuguuccacgcaguuauugcu

SEQ ID NO: 57676 - RNA, 62 nt, Mycobacterium leprae
ggguggcgaguucgcggcgcaccgaguccagaucgccggugaagccacgugaucgcacaucc

SEQ ID NO: 57677 - RNA, 65 nt, Mycobacterium leprae
gugcguugccguuauguuacggggcuggccuugcgcgaggaagagcuggacauacggacgcgcac

SEQ ID NO: 57678 - RNA, 70 nt, Mycobacterium leprae
gugaugaauuugaucuugucauuguuacgggcgcgaccgagcaugaucuuagaagcucggaauucgucgc

SEQ ID NO: 57679 - RNA, 66 nt, Mycobacterium leprae
gucuacauguugaugaugccaggggcugggcaccugggcugugcugaaggcgauaucgaugcaggc

SEQ ID NO: 57680 - RNA, 60 nt, Mycobacterium leprae
gucuuugcuaacgguuuggucuccccauaucgguggccccaucuugguuagcgggaagac

SEQ ID NO: 57681 - RNA, 63 nt, Mycobacterium leprae
gucgcguugagccucucaaugggcugcgagcgugcggguguauucuauuaagauuaacguggc

SEQ ID NO: 57682 - RNA, 97 nt, Mycobacterium leprae
gucgucggguuuugucgcggucacggugguggugaagcgcagcacugggcguccaguuacugugccgcaacuguauucacgaggauuuuccgaagac

SEQ ID NO: 57683 - RNA, 55 nt, Mycobacterium leprae
guggucggcggccugagugcugguuauccgcccugaguauuuugccgcaggccau

SEQ ID NO: 57684 - RNA, 70 nt, Mycobacterium leprae
guucggacuuuugaagcugcuggcugaggcgaauguguuucuuccggccaggucgcuuuaguauuugaac

SEQ ID NO: 57685 - RNA, 76 nt, Mycobacterium leprae
gguggcaacaugcgcacgcagcaucgcaaaaaugccgucgauggcaugcugaugcccacgcgucgacggugccgcc

SEQ ID NO: 57686 - RNA, 76 nt, Mycobacterium leprae
ggucggggaaugccauugcuggaccuaauccaggagggcaaccugggguugauccgcgcgauggagaaguuugacu

SEQ ID NO: 57687 - RNA, 55 nt, Mycobacterium leprae
gucccgcgaccgaacccaucgguagaucccucuagcugaugccaggcuccgggac

SEQ ID NO: 57688 - RNA, 67 nt, Mycobacterium leprae
gucacugcugaacaguucgucuuagccgcaggggcaguuccuggguggugggcccugugcggaugac

SEQ ID NO: 57689 - RNA, 63 nt, Mycobacterium leprae
guaaagcacacagcgucgccccuucggacuuagcauucccggcggcgagugcgguggccuuac

SEQ ID NO: 57690 - RNA, 77 nt, Mycobacterium leprae
uguccagcccacaacgcaacugagccgacguccggauaccguaacucgucggccauuggugcugggcgucugcgaca

SEQ ID NO: 57691 - RNA, 70 nt, Mycobacterium leprae
ugugacagcaacagcgcagaauuuucugcuucaccgccaggaugggauucuugccguuguagccaucaca

SEQ ID NO: 57692 - RNA, 79 nt, Mycobacterium leprae
uggaccuuaauccgacgacccugccaucggucaacggcucugauauucaguggcgaguggugucggugcggaggucgca

SEQ ID NO: 57693 - RNA, 90 nt, Mycobacterium leprae
uggccuggguauguauuggugcaaguguccugggcgugcugcuguuaaucguugaugcaguccgggaacaccagugcaucgaugcggcca

SEQ ID NO: 57694 - RNA, 60 nt, Mycobacterium leprae
ugcugaugauuggcauggcagugaaggugagagaucuucgccgccgggccugucgcagca

SEQ ID NO: 57695 - RNA, 88 nt, Mycobacterium leprae
ugcccaccguagaagcccuacguucgcgagcuucuccacaaacggcguaaacaagaccgaaggaauuugcaacguagugcagggggua

SEQ ID NO: 57696 - RNA, 86 nt, Mycobacterium leprae
ugcaucgcucaugugugaauuuaacauguugacaagcgaauccguaguucacguguuagaauuaccggagggcuaaaucagaugua

SEQ ID NO: 57697 - RNA, 73 nt, Mycobacterium leprae
ucuuguuugcgggauugucguggcgugcacgcccaaaguuggcaauuaaccccgacggucuagcaguccaggg

SEQ ID NO: 57698 - RNA, 83 nt, Mycobacterium leprae
ucugggcggauaugccgacauugccucuauaccggcagcagcgaaugcugcugaugucgaagacaauguaugcaguuaccagg

SEQ ID NO: 57699 - RNA, 60 nt, Mycobacterium leprae
ugauaucuauacgcgaccagguagaggcagauaucgcugcacuggccgccaugggaauua

SEQ ID NO: 57700 - RNA, 64 nt, Mycobacterium leprae
ugagcccgcguugcagccagcauggccacgcgaacugguugugaauagcggcagcuugggcuca

SEQ ID NO: 57701 - RNA, 75 nt, Mycobacterium leprae
ucgccggcuucgaacuugcugcacaccgugucaucggccuacugugcgauauugucggcgaguuugauccggaga

SEQ ID NO: 57702 - RNA, 57 nt, Mycobacterium leprae
ucgagugcggcccuguugcggccaccagaaccagcgucccagcagggcagcgaucga

SEQ ID NO: 57703 - RNA, 56 nt, Mycobacterium leprae
ucgaugaauucgguuuuucuaugucauuggcaugguggaaaagugugauuuauuga

SEQ ID NO: 57704 - RNA, 84 nt, Mycobacterium leprae
ucgauugcuaugauggcgguauguaauguuggucauacaauuugaucggaucgauauguacugcgcguaacuuaacgcagucga

SEQ ID NO: 57705 - RNA, 58 nt, Mycobacterium leprae
ucccggcugcgagcauuugcaacgacgaguccaugcaaccggaugauugcggcccgga

SEQ ID NO: 57706 - RNA, 129 nt, Mycobacterium leprae
ucaccaaagaacaccguggcucggugccccgggucgcugucgagccucuuguguugauguuggcgccgcuagccccacaucuggcagaagagcuguggcugcggcugggccacaccaccucuuuggcga

SEQ ID NO: 57707 - RNA, 79 nt, Mycobacterium leprae
ucaccgaugucuuccugcaugggcugauccgcgacgaauucggucgcaagaugaguaaguccagggguaacgucaucga

SEQ ID NO: 57708 - RNA, 61 nt, Mycobacterium leprae
guuggccguugcgcugcaugcuucuuuuccaccagagcguauuagcuugcacgguaacaac

SEQ ID NO: 57709 - RNA, 66 nt, Mycobacterium leprae
uacucugccaaguuguccaggcugcgggaccauucgaaucgcagauugcccacuuuggcacgagua

SEQ ID NO: 57710 - RNA, 70 nt, Mycobacterium leprae
uacgcaacgugggguugcauuucaucugucgcgacgugugguugcgggugauaucgaccucgacggcgug

SEQ ID NO: 57711 - RNA, 73 nt, Mycobacterium leprae
gcgacagucuucuggacguaccguucuuucgcgacaucgcgaaggaaugcaggcuucagucgcuauuguucgc

SEQ ID NO: 57712 - RNA, 119 nt, Mycobacterium leprae
gcgaucgcgguucugggugcguuguuggcaaucucggagaugaucaauaugcccgccggcuucucgaucgguugggcuaugugguucauucugguuugcagcgugcuccaagcgauugc

SEQ ID NO: 57713 - RNA, 76 nt, Mycobacterium leprae
gcgccucgaauucgauugggucacccaggacgguaccggugccaugggauucgacguaguucacgcuuucgggcgc

SEQ ID NO: 57714 - RNA, 106 nt, Mycobacterium leprae
gcgcgacugguccaacgaucgcgaaaacugcugcugccaggcaugcgguggaacguaaaaaagacaucgugugugcagaguaggcgaucgggcgucuaguuagcgu

SEQ ID NO: 57715 - RNA, 69 nt, Mycobacterium leprae
gcgggccuucugagugauccgcacgauggcguccucgacgucacgcggcgcagucaucaucaggucagc

SEQ ID NO: 57716 - RNA, 104 nt, Mycobacterium leprae
gcgggcacuagaccagcugaauugauccuggcuggcccugccugugcgcgguuguucgucgccagugcgcuggcuaggcugggucccuugcuggugguuaccgc

SEQ ID NO: 57717 - RNA, 91 nt, Mycobacterium leprae
gcgguaucggcuugucagucaacuagcuuggcuucuccucacuccgcugagcggagugaggagaagccaagcuaguugacuuuaguaccgu

SEQ ID NO: 57718 - RNA, 120 nt, Mycobacterium leprae
gcguagaaaucucuauagcgcgcccgucgacucuagcaugccgguaggguuugugcggacgacacaccaccacgcaagcaguaguggcggcaucggccagccuaucgagguaauugcagc

SEQ ID NO: 57719 - RNA, 55 nt, Mycobacterium leprae
gcggugucugcucggagccaacucaggucuggguaucucauugggcgacgacugc

SEQ ID NO: 57720 - RNA, 66 nt, Mycobacterium leprae
gcgugagaaggugcgccagcgcagccgcacuaccgaggugaugcuggcgggcgcgaccguccgcgc

SEQ ID NO: 57721 - RNA, 111 nt, Mycobacterium leprae
gcgguucacucggugccgguagguuuugcgauucgcugacguggacgugcuggugcgugucgcgccaagcugcuccggucggugcugguaccugcugacgcuucuguucgc

SEQ ID NO: 57722 - RNA, 59 nt, Mycobacterium leprae
gcugguagcgaugucgagccuggcgacgaugcaggccgggcagugcagggagcuacagc

SEQ ID NO: 57723 - RNA, 94 nt, Mycobacterium leprae
gcuggcacgucgugaacgcugacccguuggagacugacgcugcucuuccugagcaguuucggauucgccgggacaagcgugcucguuuguuggc

SEQ ID NO: 57724 - RNA, 59 nt, Mycobacterium leprae
gcugcgaggcgaucgucugccgguucaccuaucuggugcugcugaugaucgcauccagc

SEQ ID NO: 57725 - RNA, 63 nt, Mycobacterium leprae
gcugcgauggucucuaaccaccgcccuacucgagcucacggugauagugcugcuguuggcagc

SEQ ID NO: 57726 - RNA, 63 nt, Mycobacterium leprae
gcucaguucagacuaguaauuagaguuacaaacguagguucgugaccuagauaugaccugagc

SEQ ID NO: 57727 - RNA, 66 nt, Mycobacterium leprae
gcuagcugaacugacuacgcucagagcguaucauacaugacaugccucugccgucaguuugcuggc

SEQ ID NO: 57728 - RNA, 55 nt, Mycobacterium leprae
ggaagaauggcuaccacgucgaucaugugcucacgauggugcgccagcuuuuucc

SEQ ID NO: 57729 - RNA, 76 nt, Mycobacterium leprae
ggaagccuaccgacucacugagcaaggugcguucgacgugaccguucgcccugcucaguagucggacccgguuacc

SEQ ID NO: 57730 - RNA, 61 nt, Mycobacterium leprae
gcuuuuggcuugacgugcuuuagcuccggaccucacccaggccagcucgucagucaaucgc

SEQ ID NO: 57731 - RNA, 69 nt, Mycobacterium leprae
gccgcgggguugcuggauugcccuggugcgauguucaccgcgagccacaauccggcggccuacaacggc

SEQ ID NO: 57732 - RNA, 65 nt, Mycobacterium leprae
gcaugguaugugguguugagacauucccagguuucacuggaugucacuucccgugccgauuuugc

SEQ ID NO: 57733 - RNA, 86 nt, Mycobacterium leprae
gcaugaucacaagcaccgacaagcgguccuguaggcagcgcgugagcuucuggaggagaggucgcauguuggagcugucgguuagc

SEQ ID NO: 57734 - RNA, 60 nt, Mycobacterium leprae
gagcugcugcuagggcacccguugcucggcagcgacgaucacacgguggccagcagccuc

SEQ ID NO: 57735 - RNA, 55 nt, Mycobacterium leprae
gaggaugaagucgacgagcuacugcgcagcggaacguugguugaccuuuauccuu

SEQ ID NO: 57736 - RNA, 89 nt, Mycobacterium leprae
gaguaguacaggaugccgauuucgauuucggggaauucgaaaaccuucguggaguuggcgaucccgaugucggcggcgaguacuaacuu

SEQ ID NO: 57737 - RNA, 70 nt, Mycobacterium leprae
gaguagcugauagacggcggcaguggcgacauugaguucguccacccucaucguagucuaccggguacuc

SEQ ID NO: 57738 - RNA, 106 nt, Mycobacterium leprae
gauggugagcgccucggugacggcaggaguucuagucggcggauugaccaugaucaccuugauccugcucggcguggugcucggcgcguugguggcguucaucauc

SEQ ID NO: 57739 - RNA, 71 nt, Mycobacterium leprae
gcaggcuguugcggacgccgcgcaccaagcugguaucgugagcagcuucccugguguagcgcacacccugu

SEQ ID NO: 57740 - RNA, 75 nt, Mycobacterium leprae
gcagagcgcugcgguuccgcuacccagucgaucagcgacgaagcugcgcugauggugucgggcggcagcgauugc

SEQ ID NO: 57741 - RNA, 82 nt, Mycobacterium leprae
gcacgucgaaaaauguuuuauuuaacuagacauccaggaaacgaacauccuuggcauuacgggugauaaagcuacggcgugc

SEQ ID NO: 57742 - RNA, 129 nt, Mycobacterium leprae
cggaggauuaccaagauguacucggguaacggucuugcgguacgagugauuccuugccuggacgucuauugugggcgugugguuaaaggggucaauuucaagaaccuccgggaugcgggugaucucgug

SEQ ID NO: 57743 - RNA, 79 nt, Mycobacterium leprae
cgcuacguacgcggccagguaucaggaaagcaucgcuggagcugugauuauucuugacuugcuugcgcguauauggacg

SEQ ID NO: 57744 - RNA, 82 nt, Mycobacterium leprae
cgccuucagcuuugccucuaccguuucagcgguguccggagauccgaugaucggcagcggugggggauccagcgcgaaggug

SEQ ID NO: 57745 - RNA, 76 nt, Mycobacterium leprae
ccggcaagcagcgcacugaguuuaugcaguguuccgguuugaucgggaagugcgaagucagucgcggugucaucgg

SEQ ID NO: 57746 - RNA, 94 nt, Mycobacterium leprae
ccggaucugaacuacgacaaugugaacgugcaagaagcgaggaucgauuuucuccucuuuugacuugucauguucaucgacgggguucagcugg

SEQ ID NO: 57747 - RNA, 85 nt, Mycobacterium leprae
ccgguaugagugaugaggagaugaagcgcuuucccgaagagcuugggaaaaugggcuucgucuucaacuucauuaccuauggcgg

SEQ ID NO: 57748 - RNA, 69 nt, Mycobacterium leprae
ccggguugucuuuggcuucggguagauuggacacgacguucuuauccaaagugcguggagccaacccgg

SEQ ID NO: 57749 - RNA, 80 nt, Mycobacterium leprae
cucgacagucagugacucgagcgauacaucaauaacccuggcgcggaacaaguguaccgcuucgauuaccuggcugcggg

SEQ ID NO: 57750 - RNA, 66 nt, Mycobacterium leprae
cuggcacccagggccugcugucagcaucguacuuguucgaugaccacgacggccaccugaugccgg

SEQ ID NO: 57751 - RNA, 84 nt, Mycobacterium leprae
cuggaucgucgccucgaugucauccggauagugguuggacccauccacgaccaagagauccuugauacgacccgugaugaacag

SEQ ID NO: 57752 - RNA, 84 nt, Mycobacterium leprae
cugaucgcaaugccgguuuucggcggggccaaucagcgucgcagcgcugcgaugugguuggcagcgcuggaaacggcacgacag

SEQ ID NO: 57753 - RNA, 80 nt, Mycobacterium leprae
cugacgaauccgguacccggcuacgcaaggaucucacuuggcgggaucuaggcaguuuucgggguaucggugguugucgg

SEQ ID NO: 57754 - RNA, 85 nt, Mycobacterium leprae
gacuggugccuuaagcugguuuugguccuggggcaggaagcguucgguuggcuugcccgggaucggcgcccaccuuggcccaguu

SEQ ID NO: 57755 - RNA, 65 nt, Mycobacterium leprae
gacaggagcacgguaacucggugcuacgcuuccauaugacgugggguaccgugcccgcuuugguc

SEQ ID NO: 57756 - RNA, 71 nt, Mycobacterium leprae
gacgacaaauuccugggacagguacugcuggacgaagcuaagaagcuaaucaguggccguccgauuugguc

SEQ ID NO: 57757 - RNA, 55 nt, Mycobacterium leprae
gacagaaaguugaucgugggcaaucgugauaucgcccaugaugacguaccuaguc

SEQ ID NO: 57758 - RNA, 64 nt, Mycobacterium leprae
cuuagaugaccaaagauccgucgcugucucggcugagaguacacgauggggguugaucuuugag

SEQ ID NO: 57759 - RNA, 56 nt, Mycobacterium leprae
cuucacucaacgggccaagugggcuaacgccaccgccgaccugcucgaagcugaag

SEQ ID NO: 57760 - RNA, 72 nt, Mycobacterium leprae
gaaaaugacgaugucgccgggcuagaugucaggugcgacuuucuccgaauccucggcgacguagugauuuuc

SEQ ID NO: 57761 - RNA, 64 nt, Mycobacterium leprae
aaauauuuugggcaagcaacagcgacggcgacucgccaccgccagugucuugucgaacuuauuu

SEQ ID NO: 57762 - RNA, 100 nt, Mycobacterium leprae
acgcugguagcugccggccauggcagaucgggauuucuguuggcaccauggacagcugagcagaucauguucgaacuugccgcggucggagcccaagcgu

SEQ ID NO: 57763 - RNA, 83 nt, Mycobacterium leprae
accuugauagccauccuggugagcuuucuucaugccuuggaacuccacgaagaaaccgcuggccuauggccauugcucagggu

SEQ ID NO: 57764 - RNA, 94 nt, Mycobacterium leprae
acggcauugucggcaucaucggccccaacgggguuggcaagaccacacuuuuuaaaaccaucguggggcucgagcagccggacggcggugcugu

SEQ ID NO: 57765 - RNA, 76 nt, Mycobacterium leprae
acggcccgcagccaggcagcugcuaggcggauguugcacgacagugacugcuuccaguugcuuggcuuuggggugu

SEQ ID NO: 57766 - RNA, 57 nt, Mycobacterium leprae
accgggaaugcacgaugccuaacgcgcuagucagccguucaucuugcaagucccggu

SEQ ID NO: 57767 - RNA, 57 nt, Mycobacterium leprae
accgcgaucgagcuugcuccuggggcguugccgcagcgucaggggcuucgaugcggu

SEQ ID NO: 57768 - RNA, 78 nt, Mycobacterium leprae
acaagaaauguucgaaguaguucgcgguaucuauaucuauccgauccgcagcuucgauauaucgaauaucaccuucgu

SEQ ID NO: 57769 - RNA, 60 nt, Mycobacterium leprae
aaugcuguguuucaaccguauuggguaagggcguccggaugcaaugcugagacauaaguu

SEQ ID NO: 57770 - RNA, 101 nt, Mycobacterium leprae
agguaaccaagccccaggugagcugaugagcacgcgggcgggacgccgaguugcgaucagcgccggcagccucgcaguacugcugggggcucuggacaccu

SEQ ID NO: 57771 - RNA, 129 nt, Mycobacterium leprae
agcgccaggguacagauugccggcguauuguauguuugguuuuucaggcuauucucuaccgcgauuggcagcgaaagaaagucaggaacccagcgaccggacgcaguaauggagucgacccgggccagu

SEQ ID NO: 57772 - RNA, 80 nt, Mycobacterium leprae
agcugggcugucaaggaugccaucgaguguggcgaacuugccagcuacaucgaugcguaucccuugaccgagaccuugcu

SEQ ID NO: 57773 - RNA, 57 nt, Mycobacterium leprae
agcugcgccccccgaaaacuaccucgucgcggguugaggcagugaucugggccaguu

SEQ ID NO: 57774 - RNA, 60 nt, Mycobacterium leprae
caccgggcacaccuguggcuuuucgcuaacugggguuuucugcuugaggguuguccggug

SEQ ID NO: 57775 - RNA, 114 nt, Mycobacterium leprae
cagaguuuguucccaaaugaucagaccuugcggcuuagucggcgcgggcauggguaauacgucggucuuguccggccaagcuaggaggucgcauuucucgggcagcggcgucug

SEQ ID NO: 57776 - RNA, 63 nt, Mycobacterium leprae
caaaugcuaugauaauuuggcugauaauaucgcuuaucaugcauccuccuaucguggcagcug

SEQ ID NO: 57777 - RNA, 67 nt, Mycobacterium leprae
caacaucucggggugcaacuuggcccgaaacccguuuaacgggaaccgaguugacaucgggauguug

SEQ ID NO: 57778 - RNA, 65 nt, Mycobacterium leprae
caacuuuugguugucgucuggcgucaggucgaaguaguuccugccgcugggcuguagccggguug

SEQ ID NO: 57779 - RNA, 86 nt, Mycobacterium leprae
cacacgucgucaucaucgggcgcgguguuacgguuggucgcccguuggggcugcugcugacacgccguuccgagaacgccacggug

SEQ ID NO: 57780 - RNA, 80 nt, Mycobacterium leprae
aucgacuggcgagucaguuccuuagcgaugccgcauggcgacgggaauggcuuuuggcugaaacugaccgaccauucgau

SEQ ID NO: 57781 - RNA, 68 nt, Mycobacterium leprae
auggggguguucggugucaaccucguuggccuaagcgccgguucaucccaagacaccagcacuuacau

SEQ ID NO: 57782 - RNA, 63 nt, Mycobacterium leprae
ccaccaucaccggcaguuuagaacucagggaauucaaaaccggaguggcccggaugauagugg

SEQ ID NO: 57783 - RNA, 66 nt, Mycobacterium leprae
ccaacgcagguaccgaaugacaucagcgucggagguguugaugaaguauugguaccaggcguacgg

SEQ ID NO: 57784 - RNA, 109 nt, Mycobacterium leprae
cauccugccgcacuucgacacccugcucaucaugucgguggaaccuggcuucggaggccaggcauuuauccccgaagugcugaguaaggugcguacaguacgcaagaug

SEQ ID NO: 57785 - RNA, 83 nt, Mycobacterium tuberculosis CDC1551
cauauuccgaaucccuugugaaguaguaaugugcgagcugagcgaugucgccgcucccaaaaauuaccaaugguuuggucaug

SEQ ID NO: 57786 - RNA, 79 nt, Mycobacterium tuberculosis CDC1551
caucgcggcccagguagugcacaccgacaacagcgucaucggcuaugacgcguuggugaucgcauuaggugcggcgcug

SEQ ID NO: 57787 - RNA, 61 nt, Mycobacterium tuberculosis CDC1551
cagucguggauuugccagggggccaguacgaagcugaacggcgcuccuuggacuacggcug

SEQ ID NO: 57788 - RNA, 86 nt, Mycobacterium tuberculosis CDC1551
cagcagacgaugacggccgacuuggcagcaguggagcaacacacgacugaucgccacacuggccagcgcgcgccacauguccgcug

SEQ ID NO: 57789 - RNA, 55 nt, Mycobacterium tuberculosis CDC1551
cauuggcaccggaaaucgccgguacccauguugccgguggucgcggucgccgaug

SEQ ID NO: 57790 - RNA, 81 nt, Mycobacterium tuberculosis CDC1551
ccacguccaggccgcgcucgacuagccggguggucagcuugccggugcccgcucccaggucgagcacgcggcgggcggcgg

SEQ ID NO: 57791 - RNA, 59 nt, Mycobacterium tuberculosis CDC1551
ccagcacucggucgaugaucuugacuugaucggauucgucgauacugaguuguucaagg

SEQ ID NO: 57792 - RNA, 63 nt, Mycobacterium tuberculosis CDC1551
ccacgagcguaacggcacugcgaaaagccgggccggaaauucgcaguggcguuacauucgcgg

SEQ ID NO: 57793 - RNA, 56 nt, Mycobacterium tuberculosis CDC1551
ccaggauggcggugcccggaucgucagcguggugacugagcagcggcguuuucagg

SEQ ID NO: 57794 - RNA, 55 nt, Mycobacterium tuberculosis CDC1551
cccagcggaaauugguugagcgcaugaucacgucgccauauaccagaucgcuggg

SEQ ID NO: 57795 - RNA, 78 nt, Mycobacterium tuberculosis CDC1551
cccgaaacugguugugccgauagccgugaagcccuccgcgagguaggccagggccgacggcacaucccaggcguuggg

SEQ ID NO: 57796 - RNA, 59 nt, Mycobacterium tuberculosis CDC1551
augguuucguggcugacauugcugaagguaaggcacgcaagaccagguacguggaccau

SEQ ID NO: 57797 - RNA, 64 nt, Mycobacterium tuberculosis CDC1551
augguuuuggccagcuuugucgucgugggaguggggccacgcacccuugggcgccagaacgcau

SEQ ID NO: 57798 - RNA, 109 nt, Mycobacterium tuberculosis CDC1551
auugguuugugucugagccguugaggcggcuggcugguuugggguugcgaugauuuuggauuuuucgugguugccgccggagaucaacucggcgcggaucuaugccggu

SEQ ID NO: 57799 - RNA, 75 nt, Mycobacterium tuberculosis CDC1551
aucggccucgaccaucaggaccuccgguuccaugcgggcuugcggaaagugacggucugaugcgagguaaccgau

SEQ ID NO: 57800 - RNA, 70 nt, Mycobacterium tuberculosis CDC1551
aucguguugacucugcguccaccaggcggguuacucgcacuuuugcgugguggacgcagagucaacggau

SEQ ID NO: 57801 - RNA, 73 nt, Mycobacterium tuberculosis CDC1551
aucaucaggcgcgacauaucgagaccgcgcgcuacaugaucgcgauaacgucgaagguguugagcuuguugau

SEQ ID NO: 57802 - RNA, 73 nt, Mycobacterium tuberculosis CDC1551
caaccgcgccgccaaugcagcguccguaccauguggacuacggugcugauguugacucugguggcgacggcug

SEQ ID NO: 57803 - RNA, 63 nt, Mycobacterium tuberculosis CDC1551
aucgaccagcucggccuucucgagaucacgcgccauggucucggccgucgcgagcuccucgau

SEQ ID NO: 57804 - RNA, 58 nt, Mycobacterium tuberculosis CDC1551
caccucgcugaugauccaugacaucggcgccaucguggaauggaucucggcgauaaug

SEQ ID NO: 57805 - RNA, 67 nt, Mycobacterium tuberculosis CDC1551
cagauucgaagugacggccugggucuuggagaucuucuuggacuccagccguucacguucgagcaug

SEQ ID NO: 57806 - RNA, 67 nt, Mycobacterium tuberculosis CDC1551
cacuucgucaaggugaugccgcgugacuacaaacggguccugcaggcgaucgcccuggcugaacgug

SEQ ID NO: 57807 - RNA, 56 nt, Mycobacterium tuberculosis CDC1551
cacuguugaucaugggccuggcaaccgugacugucgggcugguuccaacgacagug

SEQ ID NO: 57808 - RNA, 75 nt, Mycobacterium tuberculosis CDC1551
cacuggcauugcucgcggccauccugucgcgccgcuguaggcgggugguguugauugcggcgguaguggacggug

SEQ ID NO: 57809 - RNA, 89 nt, Mycobacterium tuberculosis CDC1551
caccgaccucgggcgggcgcugucgauacagcgucagcacggguuuacgugugauggagugaucggcagccacagccgcuagguuggug

SEQ ID NO: 57810 - RNA, 68 nt, Mycobacterium tuberculosis CDC1551
cacccggucgcugagcacccuggccagcaccuugcgugccaccgccagcagcucggcgauaucgggug

SEQ ID NO: 57811 - RNA, 67 nt, Mycobacterium tuberculosis CDC1551
caccagcucaucgccguagcugaggaccgcgaucccggugcucagcugcagugcggugggcgggaug

SEQ ID NO: 57812 - RNA, 65 nt, Mycobacterium tuberculosis CDC1551
cacgaucugccaugucauuccuggacuccuuugcugggucggggaguacgcgggccaggugcgug

SEQ ID NO: 57813 - RNA, 56 nt, Mycobacterium tuberculosis CDC1551
agagcgcgauccaggcgagaggaccugguaacgucgcugucccgaggucacgcuuu

SEQ ID NO: 57814 - RNA, 57 nt, Mycobacterium tuberculosis CDC1551
agcacuucucagcggcccgagcgaaaugccgcuccugggcgaccgcgacgaaguacu

SEQ ID NO: 57815 - RNA, 106 nt, Mycobacterium tuberculosis CDC1551
agucagagcgcuggccgcggcgccuggcgcgcagcacggccugcagugcgucgcgggcacgcgcugugauuggcgcgaccacgccgcggucgguagagcucuggcu

SEQ ID NO: 57816 - RNA, 83 nt, Mycobacterium tuberculosis CDC1551
agucagauucgcgagccgccaccgcuaccacccgugcugcucgagguguggccggugaucgcggucggcgcgcucgccuggcu

SEQ ID NO: 57817 - RNA, 62 nt, Mycobacterium tuberculosis CDC1551
aguggucaugaauggcgaaugggcacgcauacacgucacccaccgggucgaucaggcacacu

SEQ ID NO: 57818 - RNA, 61 nt, Mycobacterium tuberculosis CDC1551
agguucgguuacuaagggccagcgcggcacgcaaacuguugcacugacuagugaagaaccu

SEQ ID NO: 57819 - RNA, 128 nt, Mycobacterium tuberculosis CDC1551
aguuguacucgucgggcgucagcaccgcggggcccgccaacaaggugccguccggguuuaugacgccgucgccggccuugaccgccuugauggcggccugcacaucuuugcccagccgugguccggcu

SEQ ID NO: 57820 - RNA, 102 nt, Mycobacterium tuberculosis CDC1551
accgaguugcucaaaucggcagcagcggacaucaauuacgugcuggcgcuggcgcuuuucguguucgucugcuaccacacggccgguauuuggcggcgcggu

SEQ ID NO: 57821 - RNA, 88 nt, Mycobacterium tuberculosis CDC1551
accgcauacccgaccugccagggcgccaagcucaccugaucgaacgccgcgccgagcaagagcagcggccccuggguggggaugaggu

SEQ ID NO: 57822 - RNA, 56 nt, Mycobacterium tuberculosis CDC1551
accucgcugcgggaugggucgcaccacaaacgccaccaauucaccaaggacgaggu

SEQ ID NO: 57823 - RNA, 88 nt, Mycobacterium tuberculosis CDC1551
accugcacccggacggcacggcauucacuuacaucgauuacgaacgggauucggagggcauaagugaaagccugacguggucgcaggu

SEQ ID NO: 57824 - RNA, 58 nt, Mycobacterium tuberculosis CDC1551
acgcauucggcgaaggcccgcgacuccuuggaguugcgcagcgaucgcaugacugcgu

SEQ ID NO: 57825 - RNA, 116 nt, Mycobacterium tuberculosis CDC1551
aacugcaaugccacauccaggucggccuucuucagcauggcgaugacggccugcaggucgucgcgcuucuugcuggugacccggaccucgucgcccuggaucuggguuuugacguu

SEQ ID NO: 57826 - RNA, 85 nt, Mycobacterium tuberculosis CDC1551
aacgcgguuugcgccgccgcuuggcaacacugcggcccagccccggcgauagcuuggccgcugcgacaagccggcgccgcgcguu

SEQ ID NO: 57827 - RNA, 85 nt, Mycobacterium tuberculosis CDC1551
aagcgagcguauucucggggaggcccucggcgacgaccgcaccgagguggugguggcuagcaaggucuucccggucgcgccguuu

SEQ ID NO: 57828 - RNA, 87 nt, Mycobacterium tuberculosis CDC1551
aagccaucgggaaauguccauggggucagucuugcgcagcggcauccuguugcgccagcgccucccgcaggauccguccgguggcuu

SEQ ID NO: 57829 - RNA, 101 nt, Mycobacterium tuberculosis CDC1551
aagggcguucgaaugagcauguugguguccgccgacgccaagucgaugccgcuggcgguacacguguucggguugggcacccgcgugcugaacaagcucuu

SEQ ID NO: 57830 - RNA, 89 nt, Mycobacterium tuberculosis CDC1551
gaagagcgaugaggauaccccgggcggugucgagaacgcggccagaguucgagccgcucgagauugcagcgggcccucgauucgccguc

SEQ ID NO: 57831 - RNA, 61 nt, Mycobacterium tuberculosis CDC1551
gaaggcaccagagagaucaccucggaguugaugcgacgcggcgagcucgucauggucuuuc

SEQ ID NO: 57832 - RNA, 55 nt, Mycobacterium tuberculosis CDC1551
cuucagcuggccgucauagguccagauucgguccuugggcagaugccagcugaag

SEQ ID NO: 57833 - RNA, 100 nt, Mycobacterium tuberculosis CDC1551
gacaccgaaccaccguggauuugccgaccgcggaaggaccggacagcaccaccacacgucccacugccgccgguuggccacgcgcggugggcuugguguc

SEQ ID NO: 57834 - RNA, 90 nt, Mycobacterium tuberculosis CDC1551
gacaaggcgggcgcggugcgggugcugcggcuggugcucgccgaguuaagugaggaaucaccgugagcagcccagcguuccggcguuguc

SEQ ID NO: 57835 - RNA, 56 nt, Mycobacterium tuberculosis CDC1551
gaaugcgcagugccuggcugcguugcuugaacgcggccagcagcgucuuggcauuc

SEQ ID NO: 57836 - RNA, 76 nt, Mycobacterium tuberculosis CDC1551
gaagugcuggcucagccgccgggcuugccugcggccaagaaucugaccccgcaccgguggcugaugcgagagcuuc

SEQ ID NO: 57837 - RNA, 66 nt, Mycobacterium tuberculosis CDC1551
gacagccaggccgucgcgaccaugcucgccgugaucgggguggauucgcucgaugaccuggcaguc

SEQ ID NO: 57838 - RNA, 75 nt, Mycobacterium tuberculosis CDC1551
gacuguccuguggcucggugguugguugccgaucacccgguguuuggcucagauugccggugccgcaugaugguu

SEQ ID NO: 57839 - RNA, 86 nt, Mycobacterium tuberculosis CDC1551
gacgugcgcggccgacggucagcuguguccgcacaaccgggcacccucggugacggacugcacagcgauggaccgcguaacccguu

SEQ ID NO: 57840 - RNA, 62 nt, Mycobacterium tuberculosis CDC1551
gacggcuggcucggcgacuggacuaucuucuacugggguugguggaucagcugggcuccguu

SEQ ID NO: 57841 - RNA, 127 nt, Mycobacterium tuberculosis CDC1551
gacgacggugucgauguucagcgucaaguuguccucggugaucaccgguugcggcggaaacgacaccacccgcucgcgcagguccacccgagcccggacgcggucgaugaacggcaccaacagcguc

SEQ ID NO: 57842 - RNA, 66 nt, Mycobacterium tuberculosis CDC1551
gaccgccgugguggugagcaccaacggugccaucucgguccgggugaauaccgccaugucacgguc

SEQ ID NO: 57843 - RNA, 56 nt, Mycobacterium tuberculosis CDC1551
gagaacugaccgugguuacgcaugagcuauugguuaaggcggccggggcggugcuc

SEQ ID NO: 57844 - RNA, 87 nt, Mycobacterium tuberculosis CDC1551
gagacacggaucgcgcgucucggcgaguggggcgcagucgggcuauauguuucauucagacgagaggcgugaacacccugaaaucuc

SEQ ID NO: 57845 - RNA, 55 nt, Mycobacterium tuberculosis CDC1551
cucccggcuggugccgcacaagcagaucgaggacgcguuggcagcggucgcggag

SEQ ID NO: 57846 - RNA, 61 nt, Mycobacterium tuberculosis CDC1551
cugguuaggcgggacggggaguguuacugcuugacugcuccuugggacgucuguugcacag

SEQ ID NO: 57847 - RNA, 73 nt, Mycobacterium tuberculosis CDC1551
cuguucuucggugagaucucuggugcgcagaucccggucaaugccgguggccgccaggauuucguucgagcgg

SEQ ID NO: 57848 - RNA, 79 nt, Mycobacterium tuberculosis CDC1551
cguugccagcaaucgcaaagcccggcacaacuauucgaucaucgagguguucgaggccgggguugcgcugcaaggcacg

SEQ ID NO: 57849 - RNA, 81 nt, Mycobacterium tuberculosis CDC1551
cguguggugggcgcuggcggucaucgucguugccggacucaccguuaccgccaggaugacgccgcagcgcucgcuuacgcg

SEQ ID NO: 57850 - RNA, 69 nt, Mycobacterium tuberculosis CDC1551
cguugggggugaccugcgcggcagggucaucugccgaggugaccaauacacggagguucugccccagcg

SEQ ID NO: 57851 - RNA, 129 nt, Mycobacterium tuberculosis CDC1551
cgucguggucaccggccgggucaccgacgccucgguggucgucggggcggcggccgcgcacuucggcuggggccgcaccgacuaccaccgacuggccggcgccgugguggccgggcacgugaucgaaug

SEQ ID NO: 57852 - RNA, 59 nt, Mycobacterium tuberculosis CDC1551
cggugguggccaccgcagugggugugaucuugucgaucggcucggugaccagccgcacg

SEQ ID NO: 57853 - RNA, 55 nt, Mycobacterium tuberculosis CDC1551
cguggaauuucuucgccauggggggcggauugccauggcgcacagaggauuuacg

SEQ ID NO: 57854 - RNA, 93 nt, Mycobacterium tuberculosis CDC1551
cgucagcggacauguggcgcgcgcuggccaguguggcgaucagucguguguugcuccacugcugccaagucggccgucaucgucugcugugcg

SEQ ID NO: 57855 - RNA, 69 nt, Mycobacterium tuberculosis CDC1551
cggugggcgcgccgccgcguggcgauggcgguuaccgcgcugcuggguuaccugguggcggccucgccg

SEQ ID NO: 57856 - RNA, 59 nt, Mycobacterium tuberculosis CDC1551
cgguucuuggccaggccgcugaccagcugcugcagcuggucgacacuggccgaaaauug

SEQ ID NO: 57857 - RNA, 69 nt, Mycobacterium tuberculosis CDC1551
cguccgccaucaccggcggcugggaggauuucacggucgucgucaccugcacggugguugccucggacg

SEQ ID NO: 57858 - RNA, 58 nt, Mycobacterium tuberculosis CDC1551
cgucgccggucucccagucgaagaugugauugucgcucuuucccuccagaucggugcg

SEQ ID NO: 57859 - RNA, 62 nt, Mycobacterium tuberculosis CDC1551
ccgggcgcacgcuaucgggccauggagcaguuuuucgccgccagccauagcggagugccggg

SEQ ID NO: 57860 - RNA, 68 nt, Mycobacterium tuberculosis CDC1551
ccggcgaucgcagccacggaguucgauuaccuggagaugugggcucaggauguggcugcgaugguggg

SEQ ID NO: 57861 - RNA, 63 nt, Mycobacterium tuberculosis CDC1551
ccggcuucugcaccagcgggucaaccagggcgugguagcgguugacccacugggccgagucgg

SEQ ID NO: 57862 - RNA, 130 nt, Mycobacterium tuberculosis CDC1551
ccggcuggcaucgauacugcgcgauguccuuccugccgaggaggaacccgacggcgcgcugacgguucgccaugacgguacguuugccucguugcggguagugagcaucgcugaggaccucgagcuggug

SEQ ID NO: 57863 - RNA, 57 nt, Mycobacterium tuberculosis CDC1551
ccggaucuggcccguucgaucaggacagcguugaucgcguccugggccauggcccgg

SEQ ID NO: 57864 - RNA, 81 nt, Mycobacterium tuberculosis CDC1551
ccgcgcuguuugacgucagcgccgcccggucgcugcucgaccggccuacggcgcgggcggugcugagucgcuucggcgcgg

SEQ ID NO: 57865 - RNA, 75 nt, Mycobacterium tuberculosis CDC1551
ccgcggggaccaugcaucggaagaaccggcaugacaauguucaggccgaguucgucaugcagcuuccaggcgcgg

SEQ ID NO: 57866 - RNA, 73 nt, Mycobacterium tuberculosis CDC1551
ccgaaucgaucgcgauggcggccagcgcggacgccgacaauccgugucuggccgacgccaucagcgauccagg

SEQ ID NO: 57867 - RNA, 96 nt, Mycobacterium tuberculosis CDC1551
cccgggugcuggcgaucuggccggacugggugcggcgguggcccacgccgucggccaccgccacggccagcaccgccgauguguuacgcgccuggg

SEQ ID NO: 57868 - RNA, 71 nt, Mycobacterium tuberculosis CDC1551
ccgcaccgccggccugucccacgaucuucgacaccgcagcgauaucgucgucgugggcauccggggugcgg

SEQ ID NO: 57869 - RNA, 55 nt, Mycobacterium tuberculosis CDC1551
ccgcccggcugcgcgagcugggcccaugacggucagcuacggcgcacccgggcgg

SEQ ID NO: 57870 - RNA, 82 nt, Mycobacterium tuberculosis CDC1551
ccgccgacgacgcgggacagcuuggucuuucgcggcacccggaucucggugccggccuugcggaugaccugccagucggugg

SEQ ID NO: 57871 - RNA, 59 nt, Mycobacterium tuberculosis CDC1551
ccgacgcgcugccgagcgaacccgagcaggacggguucaucaaggacgcgugcacccgg

SEQ ID NO: 57872 - RNA, 92 nt, Mycobacterium tuberculosis CDC1551
cgaccccaccgagcgggugguggucgccaacgccgaccaacugcugaucguggucgcgcuggcagacccgccgccacgcaccggccuggucg

SEQ ID NO: 57873 - RNA, 63 nt, Mycobacterium tuberculosis CDC1551
cgagauuccccgccgaugcugucaaggcagccugcuuggacaccauuccguugggaugacucg

SEQ ID NO: 57874 - RNA, 129 nt, Mycobacterium tuberculosis CDC1551
cgaccucugccugucgagcuggcugcuggccaugucgguccuuccagcacggggcagaacgcgaugucccgacuguagguaaggcgcugacgggaugcaaaucgcuugccggacgacggcucgccguug

SEQ ID NO: 57875 - RNA, 79 nt, Mycobacterium tuberculosis CDC1551
ccuguagcgcgagcagacgcaaaaucgcccgaaagccaucgguuucgggcgauuuugcgucugcucgcgccaacauagg

SEQ ID NO: 57876 - RNA, 68 nt, Mycobacterium tuberculosis CDC1551
ccuacaccuggcgugcuaucgcgcauucgacgacauuggcagcgugauccacagccacccgguguggg

SEQ ID NO: 57877 - RNA, 86 nt, Mycobacterium tuberculosis CDC1551
ccugcagcggcgccgccguugcgugagucugccgcggugcgaccggaggccaggcuggugucggcgguggcgccagcucccgcggg

SEQ ID NO: 57878 - RNA, 86 nt, Mycobacterium tuberculosis CDC1551
ccugcgaccacgucaggcuuucacuuaugcccuccgaaucccguucguaaucgauguaagugaaugccgugccguccgggugcagg

SEQ ID NO: 57879 - RNA, 103 nt, Mycobacterium tuberculosis CDC1551
cgcgacucaggugaucggaugcguuggcagcgugaaguguucgggcggcaccgucgggccgcucgggggccgcgucgccaguggcgucgugaucccgucgacg

SEQ ID NO: 57880 - RNA, 70 nt, Mycobacterium tuberculosis CDC1551
cgccggccagcuggugagcggccaccacccgccgguugaguucggaggccagcucggccagcuggacgcg

SEQ ID NO: 57881 - RNA, 58 nt, Mycobacterium tuberculosis CDC1551
cgccucccgccgugugucgcgggcuugcccguggaguuccgugaauuggcgguaggug

SEQ ID NO: 57882 - RNA, 57 nt, Mycobacterium tuberculosis CDC1551
cgccggcccaggcccgugaccuggugaccgagaccggggcucgagggcuggccggug

SEQ ID NO: 57883 - RNA, 82 nt, Mycobacterium tuberculosis CDC1551
cgccggcgcguccggaucgucgaugguagcguucgcgacgacggacagcaugucgucggcagguucggcgcguuuaccggcg

SEQ ID NO: 57884 - RNA, 77 nt, Mycobacterium tuberculosis CDC1551
cgccggcggucagcacgcaugugcgguggccgacgcccucggcauccgcacggugcugaucccaccaauggccggcg

SEQ ID NO: 57885 - RNA, 89 nt, Mycobacterium tuberculosis CDC1551
cgcuacuugugccgccgaacagacacaaaaccacccuauuucgaccagaaucgggugcuuuugcgucugcucggccaacuaagcuagcg

SEQ ID NO: 57886 - RNA, 59 nt, Mycobacterium tuberculosis CDC1551
cgcggcgggcgugugggcgggugagaucgacccgucccugaggcuacgccccagccgcg

SEQ ID NO: 57887 - RNA, 117 nt, Mycobacterium tuberculosis CDC1551
cgcugggagugccgcuguuucaggagcagcugaugcaguuggcggucgacugcgccggcuuuuccgccgccgaggccgaccagcugcgccgcgccaugggguccaaacgcuccaccg

SEQ ID NO: 57888 - RNA, 65 nt, Mycobacterium tuberculosis CDC1551
cgcugucgccgcugauucugcagcgcgccggccagcuccggcaccugcugauggcggcgauaucg

SEQ ID NO: 57889 - RNA, 73 nt, Mycobacterium tuberculosis CDC1551
cgaucgguggugauugagggugugggccacgucggccaaggccacgucagcgccgggcccuuccauccaaucg

SEQ ID NO: 57890 - RNA, 96 nt, Mycobacterium tuberculosis CDC1551
cgaucuguccguggacgcugccgcggccgucgcggguaacccaucccuggcgaaacugcggaccgcgcaaccaaaauucguccgccgcaccuaucg

SEQ ID NO: 57891 - RNA, 80 nt, Mycobacterium tuberculosis CDC1551
cgaauuccagguugaccuugcgcccggccagcagcagcgagugaccguagcuguggccggcgucgauaacgcugguaacg

SEQ ID NO: 57892 - RNA, 85 nt, Mycobacterium tuberculosis CDC1551
cgagcggucgccgggaguaaucaccgccaugccaucggucagccgcuccaacacauggucggcggucauacccgcggccagcacg

SEQ ID NO: 57893 - RNA, 60 nt, Mycobacterium tuberculosis CDC1551
cgauugauauuaccgauggaaugucuuagacauaagacaugacaucaguaaugucucacg

SEQ ID NO: 57894 - RNA, 68 nt, Mycobacterium tuberculosis CDC1551
cgcccagcaucacaucgaggucaccacgccggaguacccgcuuggccaagccgaucgugcgcugggcg

SEQ ID NO: 57895 - RNA, 60 nt, Mycobacterium tuberculosis CDC1551
cgcacggucagcgccgacgacgagccaaagugcagccugugccaagcgcugaccgcugcg

SEQ ID NO: 57896 - RNA, 59 nt, Mycobacterium tuberculosis CDC1551
cgcacggugaguaguaauucggaugcugcugcggcauccaugagcagcucgccgccgcg

SEQ ID NO: 57897 - RNA, 128 nt, Mycobacterium tuberculosis CDC1551
cggaaugacaagcugauguaccuggugcuggugugcgcgaucguggcuggccuggcaugcacgcugaugggcgccacccaugagggcgauaugcacgauuaccggcgcucggugucggucugguuccg

SEQ ID NO: 57898 - RNA, 81 nt, Mycobacterium tuberculosis CDC1551
cggccgaucccggauacguggcaaaugugaucccgugcgaacagcgcacgcuggucuugucggcguuuccggcugaggccg

SEQ ID NO: 57899 - RNA, 88 nt, Mycobacterium tuberculosis CDC1551
cggcaucggguagccguuacaggucaccacguagcggugccggucggcgccgaugaugcggaccuggaugcgcucgaccgacgagucg

SEQ ID NO: 57900 - RNA, 125 nt, Mycobacterium tuberculosis CDC1551
cggcgccgauguuagcggcagcggccgccugggaugaucuagccuccgagcugcauugugcugcaaugucauucgggucgguuacgucgggauuggugguugggugguggcagggaucggcgucg

SEQ ID NO: 57901 - RNA, 71 nt, Mycobacterium tuberculosis CDC1551
gcacuuccucaagcaccgcgcgguccaggcucaccagcgucaggccaugggccggguucuugaccaacugc

SEQ ID NO: 57902 - RNA, 73 nt, Mycobacterium tuberculosis CDC1551
gcagcccaagucggccugcacgagguugagccgaucggccacgccucgacgcacggccucgcuguccagcugc

SEQ ID NO: 57903 - RNA, 60 nt, Mycobacterium tuberculosis CDC1551
gcaacguggcugauuugaauuccagcaccuugggcugguccagcucguacaccacggugc

SEQ ID NO: 57904 - RNA, 91 nt, Mycobacterium tuberculosis CDC1551
gaugcgaccgauggugguuugguugccuaccgcgugggcgcgcaccaccacgcguccgcgcaccacgaccgaaccggcgugcacgcgcguu

SEQ ID NO: 57905 - RNA, 73 nt, Mycobacterium tuberculosis CDC1551
gaugccgcgcugcgcgccuugauccggcugucggagaauccagacaccggaugggacgagcucaacgcggcuc

SEQ ID NO: 57906 - RNA, 59 nt, Mycobacterium tuberculosis CDC1551
gaugagucggcagguggcugucagagcuuguugagcgccugggccagugccgacuucuu

SEQ ID NO: 57907 - RNA, 67 nt, Mycobacterium tuberculosis CDC1551
gaugcccucggcggccagcagcgccgccaguucguuuuggcugcgcaccugcgccgacgacaggauc

SEQ ID NO: 57908 - RNA, 70 nt, Mycobacterium tuberculosis CDC1551
gaucuggccguccggcgucccgacaaaaagcaucccggaugcgggcagucgagcgucgccggccaccguc

SEQ ID NO: 57909 - RNA, 55 nt, Mycobacterium tuberculosis CDC1551
gaugagcgagcgacagcgugcggcgacaccggcuuacgacuuccgcccguuuauc

SEQ ID NO: 57910 - RNA, 94 nt, Mycobacterium tuberculosis CDC1551
gaugaccgggcgauucgcaaucagcuggucgagcucugcuuugagucggucaugugacucuugggucaaccaggugacuugaguauccgucauc

SEQ ID NO: 57911 - RNA, 122 nt, Mycobacterium tuberculosis CDC1551
gcaguuguccagggcccgcugcuuuacgucccgcagaucguggccccggauucgacgauguguugccucguccaggccgucgaacugcagguagaugugcacgggguggccgggacgguugc

SEQ ID NO: 57912 - RNA, 67 nt, Mycobacterium tuberculosis CDC1551
gcauguccggcagaugaucgccgaccgggaacuggaaaccuggcugguggucgacaugucggccagc

SEQ ID NO: 57913 - RNA, 58 nt, Mycobacterium tuberculosis CDC1551
gcaugcccagcaggguggcguguaggcaaaacccagccagcccgaugcugagcaaugc

SEQ ID NO: 57914 - RNA, 113 nt, Mycobacterium tuberculosis CDC1551
gcauuucguggaagaccuggugcuggagggcacgcucgaggcccgaggcaagaucgccaugcuggccaaggugcgucgcgccccggcacugaucaaggucgaauccguggugc

SEQ ID NO: 57915 - RNA, 80 nt, Mycobacterium tuberculosis CDC1551
gccaucggcgucgaccugguggccggugccgacaccucgguggccgggguacccgagcuggccggcaagacgcugguggc

SEQ ID NO: 57916 - RNA, 68 nt, Mycobacterium tuberculosis CDC1551
gcccgcacguggccgccggugaucgcgucggccagugccgccucguccaccaggccgccgcgcgcggc

SEQ ID NO: 57917 - RNA, 76 nt, Mycobacterium tuberculosis CDC1551
gcccgagccgugauccuggcaaugggcgcagcggcacgcuaucugcaggugcccggcgaacaggaauugcucgggc

SEQ ID NO: 57918 - RNA, 58 nt, Mycobacterium tuberculosis CDC1551
gcccauagugggcgcgccgagccguugacgacgaucaggcugcgcacccgcucggggu

SEQ ID NO: 57919 - RNA, 85 nt, Mycobacterium tuberculosis CDC1551
gccgcucgucgucauggucacuggcugugacugaguuguggaucuuguucaggcacagguaguuccgucgaccuuugagcagggc

SEQ ID NO: 57920 - RNA, 77 nt, Mycobacterium tuberculosis CDC1551
gccgccgggcgggugcucugcgcggucacccauggccugcugugggcggucaucgcgccgaucgccacccggcuggu

SEQ ID NO: 57921 - RNA, 59 nt, Mycobacterium tuberculosis CDC1551
gccgccucgccgagcacgccggccgccggcuuaucgguuucucggccgaacuuggcggc

SEQ ID NO: 57922 - RNA, 67 nt, Mycobacterium tuberculosis CDC1551
gccgcgcuggacaucgccaucccccgcuggucgaggacaccggccagcacaggcgcgauugcguggc

SEQ ID NO: 57923 - RNA, 81 nt, Mycobacterium tuberculosis CDC1551
gccgcaccgaaguccgggcuguaguacugauccucauacgacgggaugguguacgccgcagcgcgggccuccucggugggc

SEQ ID NO: 57924 - RNA, 105 nt, Mycobacterium tuberculosis CDC1551
gccgccagccccgacgacaacccgaugcccggcgggauguaccgcaaccaagugugguuucccuacccgggcagcaaugucgcguugugcgugggcaugugcggc

SEQ ID NO: 57925 - RNA, 68 nt, Mycobacterium tuberculosis CDC1551
gccgccacgugggcgcugagcgccugauaugccugggcaugagcgccgaacagcgcugagauggcggu

SEQ ID NO: 57926 - RNA, 77 nt, Mycobacterium tuberculosis CDC1551
gccguggccccgucguagagcuuggccagcugauugaccaccagcgcagagcuuuucacgacgcugguuuccauggu

SEQ ID NO: 57927 - RNA, 64 nt, Mycobacterium tuberculosis CDC1551
gccguaucagccucaacucggcgugccgaccgcgugguugguggcaccggucgaagcgggcggc

SEQ ID NO: 57928 - RNA, 112 nt, Mycobacterium tuberculosis CDC1551
gccggauagcagcgguacacgucggcgcuugggaagguuacagcugguuggcguucggaaccaccaaugggauguugccgagcaucaccgacagugcgccgcccacagcggc

SEQ ID NO: 57929 - RNA, 105 nt, Mycobacterium tuberculosis CDC1551
gccggcggcgaauuuguagaugucgcguuugcgcaggggcaugucagcguaugugcucgacgcgacgaauccacugcgcuugacgaggcgguacgucgcgccggc

SEQ ID NO: 57930 - RNA, 55 nt, Mycobacterium tuberculosis CDC1551
gccggcugacgacuagcgcaccagcccuugccgugguggcuguuguugcgccggc

SEQ ID NO: 57931 - RNA, 70 nt, Mycobacterium tuberculosis CDC1551
gccgguggcagagauaucguagugaucgggcucgaucaggcccggauguucugcggucucgccgccaagc

SEQ ID NO: 57932 - RNA, 91 nt, Mycobacterium tuberculosis CDC1551
gcuuuucggcgagacggcgcgccuugucgagaucgucgccgugggugacaccgacgaacgcgaccaggcccugcccguccggccggauagc

SEQ ID NO: 57933 - RNA, 56 nt, Mycobacterium tuberculosis CDC1551
gcuugccggguuugaucagcucggucuuguauaggccguugaucgucucggcuagu

SEQ ID NO: 57934 - RNA, 78 nt, Mycobacterium tuberculosis CDC1551
gcugucaucgaugucacggucgugacccgcugccaccaucucgaagucggcgguggugaccgccgcgacgucugcggc

SEQ ID NO: 57935 - RNA, 64 nt, Mycobacterium tuberculosis CDC1551
ggacggcaccaagucaccggcauccaaguagcguuuggcuuccacgccgagcuuggugcccucu

SEQ ID NO: 57936 - RNA, 77 nt, Mycobacterium tuberculosis CDC1551
ggacgacuuuuuucggccgcugucaaagccguugcgggccuugccauaugcggccgacgaccuagaccugucgaucc

SEQ ID NO: 57937 - RNA, 74 nt, Mycobacterium tuberculosis CDC1551
gcuacccgcccggggcauggccaagcuggcuuucgaugugaccccgccggccuggcuggagcccgggcaguggu

SEQ ID NO: 57938 - RNA, 69 nt, Mycobacterium tuberculosis CDC1551
gcuacucggcggacaucggaugcguccggcugaccgaacgcuguuugcacuccgacccgccgacguugc

SEQ ID NO: 57939 - RNA, 64 nt, Mycobacterium tuberculosis CDC1551
gcucagcgcuggccgcgacguccagcgguggcagcaccgggguaucaggcagccggcgcugcgc

SEQ ID NO: 57940 - RNA, 92 nt, Mycobacterium tuberculosis CDC1551
gcucaauccgaacgaaacccaggugcuugccauggcaguuaaagccaagcccggcaaaacacuaugcagcauuugggaucucacugauuggc

SEQ ID NO: 57941 - RNA, 116 nt, Mycobacterium tuberculosis CDC1551
gcucagcaucugcgccuucaugcucuucauggucuggaucaucucgggcaucaucgcggucagcuggggcaugagcguguccaggcgcugcaugagcggcagcagguuguugaugu

SEQ ID NO: 57942 - RNA, 62 nt, Mycobacterium tuberculosis CDC1551
gcugcaaacccuagaguacuuauucgucguugugucaacagguaguugcuggggugugucgc

SEQ ID NO: 57943 - RNA, 82 nt, Mycobacterium tuberculosis CDC1551
gcugcucaacuacuacccgcaucuguuggcgcucucggccucaucacccuggugggguggcgaagacaccggguaugccagc

SEQ ID NO: 57944 - RNA, 81 nt, Mycobacterium tuberculosis CDC1551
gcugcgggucgauguugucggcuucggucuuggccaccgcgaagaacuccgaaucgaagcccuugauguccuucagguagc

SEQ ID NO: 57945 - RNA, 67 nt, Mycobacterium tuberculosis CDC1551
gcuggcuuucgcgcugggccuuuugacgcugggauugaucaagggcccggauugggguugggccagc

SEQ ID NO: 57946 - RNA, 93 nt, Mycobacterium tuberculosis CDC1551
gcgucuaugaugucgccaagcgccaccccgaggugcaccagcgggccggcaccgccggaguagccggaguggcccuugcauacgacguagagc

SEQ ID NO: 57947 - RNA, 55 nt, Mycobacterium tuberculosis CDC1551
gcgguguuaucugcuccguugccgccguuaccgccgucaccgccgaugccaccgc

SEQ ID NO: 57948 - RNA, 74 nt, Mycobacterium tuberculosis CDC1551
gcggugagggcuagccgucagcgucgaaguugcgggcccgcaacgaucgcugcaccgcggccuggcccucgagc

SEQ ID NO: 57949 - RNA, 71 nt, Mycobacterium tuberculosis CDC1551
gcggugcugcacgccuucgccagcaagcugcccaaccagaagcugccguucgggguggugccaaacaccgu

SEQ ID NO: 57950 - RNA, 97 nt, Mycobacterium tuberculosis CDC1551
gcgguauuuggagccggcgaccaucgagccgagaucgagcgcgacgauggucuugucgcgcaagcucuccggcacgucgccggccacgaugcgcugc

SEQ ID NO: 57951 - RNA, 69 nt, Mycobacterium tuberculosis CDC1551
gcgggauucgucgauguggccaugugcggguuguuucauggcccacgccugcgcgacauggacgcccgc

SEQ ID NO: 57952 - RNA, 129 nt, Mycobacterium tuberculosis CDC1551
gcggucggcucaagccgaacauccgggucgggugauguuggucgauucggacggcucgauggauguuggagaugucauuggcuguggugaagagcaauugaugauccggaacggcacagccuaugccgc

SEQ ID NO: 57953 - RNA, 88 nt, Mycobacterium tuberculosis CDC1551
gcgggggcacucgacgaguccggucugcgacccgaggaucucgacguguugaucaccgccacggucaccggacuggcggugccgucgc

SEQ ID NO: 57954 - RNA, 86 nt, Mycobacterium tuberculosis CDC1551
gcgggcuucgagcagcugggcgccgacgcuuugcacaccgaagacguguugcugaagguccggcugcgccaggggcuaccgcucgc

SEQ ID NO: 57955 - RNA, 57 nt, Mycobacterium tuberculosis CDC1551
gcggccaaccggcccgccuacuauuuucagucgugacgauccaugucgguuggccgu

SEQ ID NO: 57956 - RNA, 59 nt, Mycobacterium tuberculosis CDC1551
gcggccaagggugcggacgccgaugucgcgaucauugacgcgcgcgccgacuuggcggc

SEQ ID NO: 57957 - RNA, 78 nt, Mycobacterium tuberculosis CDC1551
gcggccacggugugcuggugugcgcgccgaccggcgcuggcaagacgguggucggcgaguucgccgugcaccuggcgc

SEQ ID NO: 57958 - RNA, 79 nt, Mycobacterium tuberculosis CDC1551
gcggccauccugguuggcugcggugccacgaacgaucgccagcacacgaucaccgucgcgcaccgcauccgguagccgc

SEQ ID NO: 57959 - RNA, 56 nt, Mycobacterium tuberculosis CDC1551
gcggcgcugaugaacgguugcacgaacugacccggcagcagguucaccacguaugc

SEQ ID NO: 57960 - RNA, 62 nt, Mycobacterium tuberculosis CDC1551
gcggacugucccgagcgcaccaggaaucgaaccaggcuuccuugugucaucgggcaggucgc

SEQ ID NO: 57961 - RNA, 76 nt, Mycobacterium tuberculosis CDC1551
gcgcgaacgcgggucggcgucuccaguuucuauuucuugacauggaaaaacggcggccccgacccugccucagcgu

SEQ ID NO: 57962 - RNA, 100 nt, Mycobacterium tuberculosis CDC1551
gcgcagccgcgaaucaucgaaucgcuugccgaugccgucggucugggugacgccgugcagauccggauauuggccggugaaaaucgucgggcggcugggc

SEQ ID NO: 57963 - RNA, 76 nt, Mycobacterium tuberculosis CDC1551
gcgcaagguggcagccagcgccuccgggacacgggccuugauccgggugcccucgggcuugugcuccgccugcugu

SEQ ID NO: 57964 - RNA, 64 nt, Mycobacterium tuberculosis CDC1551
gcgcaacugcaucgccaccacuuccucggccagcgaggccagugucggcagaucagugaucagc

SEQ ID NO: 57965 - RNA, 128 nt, Mycobacterium tuberculosis CDC1551
gcgccagcgcggcgagaucacccgcgcgggggucaccggccuggugcucaauagcccguuccuggaucugcaaggcccggcaauccugcgccugccgcugaccucggcguucuucgccgcgauggcgc

SEQ ID NO: 57966 - RNA, 67 nt, Mycobacterium tuberculosis CDC1551
gcgacggccggguuuuggugcaguaccuucagauugagccgguugggccaccaguccugguuuccgc

SEQ ID NO: 57967 - RNA, 63 nt, Mycobacterium tuberculosis CDC1551
gcgacugcucggcggugaacugcgccagggcgcaaagggcgggaucauggccgaugcggucgc

SEQ ID NO: 57968 - RNA, 130 nt, Mycobacterium tuberculosis CDC1551
gcgacuugggcauaggcccacccugccagauaccuugacauauaucaaagagauguugcacacuggguucggcgccauuuugauauaagucaaacaacugggaggugucuaccaaugucccgcguucagc

SEQ ID NO: 57969 - RNA, 57 nt, Mycobacterium tuberculosis CDC1551
gcgagcuggaaugcggugugcucgaaaugccggacggcacacuggaagccagcacgc

SEQ ID NO: 57970 - RNA, 69 nt, Mycobacterium tuberculosis CDC1551
gccuggcgagcagacgcaaaagccccuaauaccugccgguuuagggggcuuuugcgucugcucgccggc

SEQ ID NO: 57971 - RNA, 63 nt, Mycobacterium tuberculosis CDC1551
gccuuucgguggcgccagcucgaugugguaggaacccagcaggcugguggugccgaucuuggc

SEQ ID NO: 57972 - RNA, 107 nt, Mycobacterium tuberculosis CDC1551
uaaccugcgcccguccgaagcgcccggcuuuuucguaggcuucgcugcgguuggggccagacagcgccgugaagcccgguggguguggccggcugacgggaugguug

SEQ ID NO: 57973 - RNA, 106 nt, Mycobacterium tuberculosis CDC1551
guuguucgucgucgucgcgaucaccaucgcuggcgcuucgcugucgaugcgcauuccgcgcugggucgaggugaccagcggugaggucccggccacauugagcuac

SEQ ID NO: 57974 - RNA, 68 nt, Mycobacterium tuberculosis CDC1551
guuucagcgccaauacaucacggcagcgggccgaacccuggcgugucacaaaguaauuggugcgcaac

SEQ ID NO: 57975 - RNA, 58 nt, Mycobacterium tuberculosis CDC1551
guuuggcgcgcccacagcccgggcggaaagcccgucgggccgucgggugugcgcagau

SEQ ID NO: 57976 - RNA, 101 nt, Mycobacterium tuberculosis CDC1551
guuucgccuguccgaugaucgcgaguuuguccagcgucugcuuggcacggaucuccuggaccaugccgaugacgcuguuggcgaugaugagcaggccgaac

SEQ ID NO: 57977 - RNA, 57 nt, Mycobacterium tuberculosis CDC1551
ucaccugcccggcaccuggagcgcgcugcgaucagccggugaagcccggguugguga

SEQ ID NO: 57978 - RNA, 83 nt, Mycobacterium tuberculosis CDC1551
ucacggccggucuccuugccuauccagcugaucgccaccgagguguccagaccgccggaauaggccaggaugacgcgcucuga

SEQ ID NO: 57979 - RNA, 60 nt, Mycobacterium tuberculosis CDC1551
uagugauucgcaucucugcaccucuucgccggugcugucaagagccaauucgaaucagua

SEQ ID NO: 57980 - RNA, 84 nt, Mycobacterium tuberculosis CDC1551
ucagcaccucuagcuugucgaccgugcggucgaauuccguuugaugcuugacggugguggccagcacgguguucaaguuguuga

SEQ ID NO: 57981 - RNA, 60 nt, Mycobacterium tuberculosis CDC1551
ucaucccgggugcgcgcaugcacaccacgguggugaucauguugaccgcgcccaggaugg

SEQ ID NO: 57982 - RNA, 82 nt, Mycobacterium tuberculosis CDC1551
ucgauauacugguggccugguccuucgccaucgaucaauggcgauagcuuaucgaggauuucuaccaacuucgugucaucga

SEQ ID NO: 57983 - RNA, 58 nt, Mycobacterium tuberculosis CDC1551
ucgccgccguagugcuccagcacccggugauccauuaccuugcgccacaacggcggga

SEQ ID NO: 57984 - RNA, 66 nt, Mycobacterium tuberculosis CDC1551
ucgaugaaugagcggucagcgucgaucgugcgacgcaggaucacacuggccugcucaaccagcaga

SEQ ID NO: 57985 - RNA, 57 nt, Mycobacterium tuberculosis CDC1551
ucgcguaugcgaagaucacgagcggcaagaugagcacgaugaugaucguguaugcga

SEQ ID NO: 57986 - RNA, 78 nt, Mycobacterium tuberculosis CDC1551
ucgcgucguggagcuccuucaucuccgcugcgcuuaauggguauccgcgcgagaagacggggcgcaagaacggggcga

SEQ ID NO: 57987 - RNA, 68 nt, Mycobacterium tuberculosis CDC1551
ucggacggcaucuccaugggucaugaggggaugcacuucucgcugguuucccgugaggugaucgccga

SEQ ID NO: 57988 - RNA, 70 nt, Mycobacterium tuberculosis CDC1551
ucgucaaguuucucagcgagcaggugcuuucccgcgcgacggagcgagugcgugcugggguacucggcga

SEQ ID NO: 57989 - RNA, 57 nt, Mycobacterium tuberculosis CDC1551
ucgucgguuuccggcaaguccccgccgcccgauacggugggcuaauggcaaccacgg

SEQ ID NO: 57990 - RNA, 85 nt, Mycobacterium tuberculosis CDC1551
ucggcauuggcgggugcugcgccuccugcggaccgugggcaugcaccacgcgcucggguugcgcgcggccuaccugccgugccga

SEQ ID NO: 57991 - RNA, 73 nt, Mycobacterium tuberculosis CDC1551
ucggaggucgugccgaucgauguguccgucgacauuccggcggucaccaucaccggcaccaggaucgacccga

SEQ ID NO: 57992 - RNA, 78 nt, Mycobacterium tuberculosis CDC1551
ucgguggcacggcgaccgcgggggcauuuucccggccgggcuugccgguggaguaccugcaggugccgucgccgucga

SEQ ID NO: 57993 - RNA, 75 nt, Mycobacterium tuberculosis CDC1551
ugacgacaacagcgagcgggagcaggccaaggaugacgguucgucggcucaucgcugcuugcauugugguaguca

SEQ ID NO: 57994 - RNA, 87 nt, Mycobacterium tuberculosis CDC1551
ugagcgccuaugaggcgguggugggugccgcgcugguggccacaccacacaccggcccggcaccggucaucgucaaacccggcgcca

SEQ ID NO: 57995 - RNA, 64 nt, Mycobacterium tuberculosis CDC1551
ucucccgcagggcacgccuagacggcggccgacgcugcccaggcguagaagguucuccggguga

SEQ ID NO: 57996 - RNA, 83 nt, Mycobacterium tuberculosis CDC1551
ucucgacgaucucgcgccguagaccuucggccaccaugggauccagacggcagagcgcggccucggcgucggcgucgucgaga

SEQ ID NO: 57997 - RNA, 59 nt, Mycobacterium tuberculosis CDC1551
ugccggcgaccgagguggcggugggccgcugagacaugacgugccucacgucgucggcg

SEQ ID NO: 57998 - RNA, 82 nt, Mycobacterium tuberculosis CDC1551
ugcgguaucgucgcugacuccguaguguuccagccgcgguaucccgguuugggccaccucggcggccagcucauauaccgca

SEQ ID NO: 57999 - RNA, 120 nt, Mycobacterium tuberculosis CDC1551
ugcgguccgggguguuggcugaacagguggcggccggaccgcugcgggaguggcuccacaagcaacgcaccggucugccgcaugucaccuggaaguacgccaccagcaucgacggccgca

SEQ ID NO: 58000 - RNA, 72 nt, Mycobacterium tuberculosis CDC1551
ugucugaggcgcugcaggagugcuuccacggccugguuggccacaugaucaauuucugagcggcucaugacg

SEQ ID NO: 58001 - RNA, 99 nt, Mycobacterium tuberculosis CDC1551
uguaugggcggggagaaccggcugaugcggugacgguggccgccgaacuggaucgccgugggcugcugcgccgcaucggcggugcucccuaccugcaca

SEQ ID NO: 58002 - RNA, 57 nt, Mycobacterium tuberculosis CDC1551
uggcgccgcuacggggcggguauaucggagauaucacgccucucggugguggggcca

SEQ ID NO: 58003 - RNA, 57 nt, Mycobacterium tuberculosis CDC1551
ugggcagcggucaaggggcccaagcaaauuccgcauggagcuccuuucgcugccgca

SEQ ID NO: 58004 - RNA, 121 nt, Mycobacterium tuberculosis CDC1551
uucgucaucuccgcacgcgcggaacccauccgccgccugcucggcggccugaaugaaacgguguucaggcuacgguagcggugcgcacggggacaaacgcgacgugggcggaggucacgga

SEQ ID NO: 58005 - RNA, 57 nt, Mycobacterium tuberculosis CDC1551
uugacccaguugauccggugugcgguucguugacaccgcaaacucguucuggguuag

SEQ ID NO: 58006 - RNA, 65 nt, Mycobacterium tuberculosis CDC1551
uuccaggccucgguggguuccgguugucguugcagccgccaaaccgcugaggaauccaccaggaa

SEQ ID NO: 58007 - RNA, 63 nt, Mycobacterium tuberculosis CDC1551
uucaugcaugugacgggccgcuggaauuggugggcaccgagaccccuggcguggcugcaugag

SEQ ID NO: 58008 - RNA, 64 nt, Mycobacterium tuberculosis CDC1551
guaccgaucguggccgguuucauggcggcgguguucgucgcguccaugguggccgggaucgugc

SEQ ID NO: 58009 - RNA, 64 nt, Mycobacterium tuberculosis CDC1551
guagcccaccggugcuguaggcgaaggugcaggcaaagaucgccagcaccaccugguugggcac

SEQ ID NO: 58010 - RNA, 62 nt, Mycobacterium tuberculosis CDC1551
guccacaacgcugcggcggcgccccacaggaaaagaacugccaacgccacucgcagugggac

SEQ ID NO: 58011 - RNA, 56 nt, Mycobacterium tuberculosis CDC1551
gucagcgucgaugaccaugucgaccccacgguguggucgauggugaugacgcuggc

SEQ ID NO: 58012 - RNA, 57 nt, Mycobacterium tuberculosis CDC1551
guccgcccuggcgauggccgaugccgaauucaccaucggugugaccacagggcuggc

SEQ ID NO: 58013 - RNA, 56 nt, Mycobacterium tuberculosis CDC1551
ggucgccggcgcuggcguagcggucuucgggcuuuuuggccaugccgcgggcgacc

SEQ ID NO: 58014 - RNA, 67 nt, Mycobacterium tuberculosis CDC1551
ggugaaguagcggcgcaccgcagaguagugaaucccggcacgaccugcgacagccguuaacgucacc

SEQ ID NO: 58015 - RNA, 82 nt, Mycobacterium tuberculosis CDC1551
ggugaguagauugcugacgaguugaugcaagcgggcaugauccccguugacccagaccggcucgucgggcagauucuucacc

SEQ ID NO: 58016 - RNA, 72 nt, Mycobacterium tuberculosis CDC1551
ggugcggucgccgcguuugggugugagaacgguugguggaaaccaaaauccgcgcccagccggagccguacc

SEQ ID NO: 58017 - RNA, 63 nt, Mycobacterium tuberculosis CDC1551
ggugccggugcgcagcgucagcucgacggcgacgccguccgggccggcuuugccgccgucacc

SEQ ID NO: 58018 - RNA, 55 nt, Mycobacterium tuberculosis CDC1551
gguggcgaaccuggguaaggccaugacaaaccuucuggucaccggguucgacacc

SEQ ID NO: 58019 - RNA, 55 nt, Mycobacterium tuberculosis CDC1551
gguggugccgguacgccaaugcccaacaaugaagauuggcggaucggcgaucacc

SEQ ID NO: 58020 - RNA, 61 nt, Mycobacterium tuberculosis CDC1551
ggugguggugaguuugagaucggcaagcugugucccaggcccgaggagacuuuccgccacc

SEQ ID NO: 58021 - RNA, 59 nt, Mycobacterium tuberculosis CDC1551
guugaugggcggcugaaggacugggcaagccucucccguuccggcccggguccagcgac

SEQ ID NO: 58022 - RNA, 119 nt, Mycobacterium tuberculosis CDC1551
gugugacggucggcgcguuggucgcgcuggcguguaugguguuggccgggugcacggucagcccgccgccggcaccccagagcacugauacgccgcgcagcacaccgcccccgccgcgc

SEQ ID NO: 58023 - RNA, 113 nt, Mycobacterium tuberculosis CDC1551
guggcccuggucgcgcugguggcagcgguagugguggugguugucgcgaccguagccuuggcccgugacgaggucgcgaugaugacgguuuccgccggcgaauugggggccgc

SEQ ID NO: 58024 - RNA, 67 nt, Mycobacterium tuberculosis CDC1551
guggcgaugccgucgucaaccaggaucacgauccuggcgcgcggaucgacgacagggcguccgccgc

SEQ ID NO: 58025 - RNA, 83 nt, Mycobacterium tuberculosis CDC1551
guggcucaggucgauacccgaggggauggcaagugucaccccgccauccuuccaccucuuuucgggugcaacgaucgggccau

SEQ ID NO: 58026 - RNA, 75 nt, Mycobacterium tuberculosis CDC1551
gucgucgaugaagucuugccauucaccguuggugaccggaacccggccgauccggaaugcgggcacgucgacgac

SEQ ID NO: 58027 - RNA, 62 nt, Mycobacterium tuberculosis CDC1551
gucggcgcggucgaaucgaucuugacggugcucgcguugcgcgaucaggugaucccgccgac

SEQ ID NO: 58028 - RNA, 129 nt, Mycobacterium tuberculosis CDC1551
gucggcucggugcagcaacgccagcagcucgguguggucgagguguccgacgaaccugguugcucugagcacccgguguuugcgggccugaucgaucaaccaauccugcugggugccuucgccggcgau

SEQ ID NO: 58029 - RNA, 79 nt, Mycobacterium tuberculosis CDC1551
gucggagaugcauuggcgcugcaguacuuucacgcagcucccuggguugcguggucggaugcaggccagcguggccaac

SEQ ID NO: 58030 - RNA, 77 nt, Mycobacterium tuberculosis CDC1551
gucgcaccucuuagcgggccauggacuggucgucgaacacguugucaccgcuuccauggcguuguuacaaccgcgac

SEQ ID NO: 58031 - RNA, 69 nt, Mycobacterium tuberculosis CDC1551
gucggugcugaauucgucggguaucuggucgaccugugugggcugcagccggacgaagcggugcucgac

SEQ ID NO: 58032 - RNA, 86 nt, Mycobacterium tuberculosis CDC1551
gugagauuccggugggcgccaaaccgaacggcgagcugcagaacaucauccugcgcgccaaggacuuuggcggcuucggguuucac

SEQ ID NO: 58033 - RNA, 66 nt, Mycobacterium tuberculosis CDC1551
gugaccaaccacccaaggaugaucggcaccgcgaagguacggaucauucuggggaugaacggucgc

SEQ ID NO: 58034 - RNA, 101 nt, Mycobacterium tuberculosis CDC1551
gugcugacgguuccgcgggccgggucucgcuuggcggcgggcagcgacugccagacccuggcgagaucgaugaaauaggucccgcggucguguccaggcac

SEQ ID NO: 58035 - RNA, 69 nt, Mycobacterium tuberculosis CDC1551
gugcccagcaccgaccagugccggccgccgagcucgauguggaugucggccugcucgguguuggugcac

SEQ ID NO: 58036 - RNA, 78 nt, Mycobacterium tuberculosis CDC1551
gggugguggugccgucgucgcgcagcccggccgcccaugagauucgcggcuccuggcgcgccacggcauccacgauuc

SEQ ID NO: 58037 - RNA, 120 nt, Mycobacterium tuberculosis CDC1551
gggugguuaccuugcgcucgcgcuugcgcagcggcugcagugcgacgacgagaaaccggcggcaauaguggccaucucuccguugcugcagcuggccaaggggcccaagcaggaccaucc

SEQ ID NO: 58038 - RNA, 85 nt, Mycobacterium tuberculosis CDC1551
ggguuugccgaucaugccccgcagcagcagcacguuggugaccucaccgaugguggccacggcgugggcguguugggucaagccc

SEQ ID NO: 58039 - RNA, 73 nt, Mycobacterium tuberculosis CDC1551
ggucauggcgcaguuggcccgggaugucggcggaccgccgcugguguuccagcugcugugguacccgacgacc

SEQ ID NO: 58040 - RNA, 62 nt, Mycobacterium tuberculosis CDC1551
gguagucaccgccgcgguuggugcgcauggugcgccgugcgaucuggacggcggcggucacc

SEQ ID NO: 58041 - RNA, 72 nt, Mycobacterium tuberculosis CDC1551
gguacgaggagcuguccgacaaaguauccgaggaacgccucgagacgauuugucggcagaucaugcuguauc

SEQ ID NO: 58042 - RNA, 71 nt, Mycobacterium tuberculosis CDC1551
gguagcgcugggcgaugaagcgcugggucaccgcgcccagcggcccggcggcuuugcucgcccaggucgcc

SEQ ID NO: 58043 - RNA, 90 nt, Mycobacterium tuberculosis CDC1551
ggggacgcguuggcgcuggccgaagccgaccggcccagcgaugacaucgacuucaaggacguucggcuuucagcgcgacgaucauccgcc

SEQ ID NO: 58044 - RNA, 62 nt, Mycobacterium tuberculosis CDC1551
ggggagacgauugccgccccgccggaaucggcggccuuggcgggcgcggcagucgccuugcc

SEQ ID NO: 58045 - RNA, 57 nt, Mycobacterium tuberculosis CDC1551
gggcggcguggccguuucaccgcguugcgaugcgcaacgcccgccaccacgccgccu

SEQ ID NO: 58046 - RNA, 87 nt, Mycobacterium tuberculosis CDC1551
gggcgucggcacugcgauggcugcgcgaggugaacgccgagcaguucgccgaccguaagccucgucagcuauccgggggccaagccc

SEQ ID NO: 58047 - RNA, 56 nt, Mycobacterium tuberculosis CDC1551
ggguaaccgcuacaaaugaaguuggucagugcuggccaacuguguaaugguugccc

SEQ ID NO: 58048 - RNA, 82 nt, Mycobacterium tuberculosis CDC1551
ggggcuacggcgaggacgaggucuggggucagcugaucaugucggagaccucgccggaccucgagcucuucaccgcgacccc

SEQ ID NO: 58049 - RNA, 70 nt, Mycobacterium tuberculosis CDC1551
ggcgguggcugcggccgaucaccgaugcgaccugguaaucgacgucgucuacgacggcccagaccucgcc

SEQ ID NO: 58050 - RNA, 120 nt, Mycobacterium tuberculosis CDC1551
ggcggucgucauacuuuccggggucgcggcggcggccaacgaggcagcggcggcccuccucggcuucccgcugcugcucgugguuggggugucgcuggccuauuuguaugucguccugcu

SEQ ID NO: 58051 - RNA, 63 nt, Mycobacterium tuberculosis CDC1551
ggcucacgauguagucgauccgaucgacgauggcuuccaccggcucgaccaacacgaugagcc

SEQ ID NO: 58052 - RNA, 95 nt, Mycobacterium tuberculosis CDC1551
ggcuugcggaguugcgggcugcccaaucagcgcugcgaccaggucucggcuggcgugcaguucggugaugugggucagcgugcagguggcaagcc

SEQ ID NO: 58053 - RNA, 64 nt, Mycobacterium tuberculosis CDC1551
ggcgagcuugcggugcaguaugucgaugaccaucgugcacagugcugaccaccgccggcucacc

SEQ ID NO: 58054 - RNA, 90 nt, Mycobacterium tuberculosis CDC1551
ggccugcgcaucgaagaugguuugcugaagaagcugggugccgaggcgguggcucagcgggucaacgaggcgcugcacaaugcgcaggcc

SEQ ID NO: 58055 - RNA, 102 nt, Mycobacterium tuberculosis CDC1551
ggccgccgcguacggggcaucgugugccgaguuggccgaucgcuaccgacaccugguggcgcugucgaucaccgacuuuggcgcugccgguccgcggucguc

SEQ ID NO: 58056 - RNA, 59 nt, Mycobacterium tuberculosis CDC1551
ggccgaaacaccgcgcgaagggcgguucaaguuuccguccccucucgugguuuuggguc

SEQ ID NO: 58057 - RNA, 69 nt, Mycobacterium tuberculosis CDC1551
ggcgcguugggaccagugcgguggcaggugaucccgauggucacugugacgccgggcuggguaugcacc

SEQ ID NO: 58058 - RNA, 105 nt, Mycobacterium tuberculosis CDC1551
ggcgaggguggugcaaacgaccuccgagguuuggcggggcgugaccuccgaaggcgccgaggcucauugguacuccgaagcccaggagguguccgacgauucgcc

SEQ ID NO: 58059 - RNA, 56 nt, Mycobacterium tuberculosis CDC1551
ggcaaggcgccggccgggcggacccccggccugcccggcaugggcagccugcugcu

SEQ ID NO: 58060 - RNA, 73 nt, Mycobacterium tuberculosis CDC1551
ggcaccccuacgucgacauuuggcaggcggucaagccacaacgaguugggcuggccgccuggccgagggugcc

SEQ ID NO: 58061 - RNA, 66 nt, Mycobacterium tuberculosis CDC1551
ggccagcgcgaugcggaacgcggugucggcggcgcuguugaugaugcggauccggauucgcuggcc

SEQ ID NO: 58062 - RNA, 119 nt, Mycobacterium tuberculosis CDC1551
ggccgacguucgcagguucugggcaauaucggcgugguugucggcuugcugcugguagcacugcuuucugagcucgagcagcucacgcccggugucgcggagcucacugaaaauaggcc

SEQ ID NO: 58063 - RNA, 79 nt, Mycobacterium tuberculosis CDC1551
ggauggguccggucagcaugaauaccgggucggcggcgcgcgcacugaugugguggaugcgggcacggggccuaagucc

SEQ ID NO: 58064 - RNA, 92 nt, Mycobacterium tuberculosis CDC1551
ggagcggccgggcucgcuggguggugggaaccgcuccagggcgggccaucccguucggcgcuuuccgccauuugaucagccugcccgccucc

SEQ ID NO: 58065 - RNA, 57 nt, Mycobacterium tuberculosis CDC1551
ggaggccgccgcgaucaccgcggcccccaaaucggccagcucggcagcggcggcucc

SEQ ID NO: 58066 - RNA, 67 nt, Mycobacterium tuberculosis CDC1551
ggacuccagcggguuugucacguagcccacuuucgucagguugcgcuuggugaacucgucagaguuc

SEQ ID NO: 58067 - RNA, 61 nt, Mycobacterium tuberculosis CDC1551
uuugcggcagaccccgauuuucgagcagaugcugaucgaugacgggauucugcuucgcaaa

SEQ ID NO: 58068 - RNA, 63 nt, Mycobacterium tuberculosis CDC1551
uuggccggcgacguuuccacgaucgcuaccacuccgccccucgucucgugggcgcgccgccaa

SEQ ID NO: 58069 - RNA, 89 nt, Pseudomonas aeruginosa PA01
uuggcuuuccagguuucccgccgggugguguccucagcgcucgccgagacgcugcugcagggccuggucccagggcggcggaaagccga

SEQ ID NO: 58070 - RNA, 66 nt, Pseudomonas aeruginosa PA01
uuggacccgcugcagguauucggugccugggacgaccggcaaacgcccugccuguacugggaacag

SEQ ID NO: 58071 - RNA, 83 nt, Pseudomonas aeruginosa PA01
uugccgccgaccuggacguacugcccggcagggguucucuccaucgccuucuugccggccauggccuccacgucggccagcga

SEQ ID NO: 58072 - RNA, 80 nt, Pseudomonas aeruginosa PA01
uugacugguaccggacuuguguuuuuacugucgaaauggucguuuuaccaagggaagcgcaaugcaagcguacgagucgg

SEQ ID NO: 58073 - RNA, 81 nt, Pseudomonas aeruginosa PA01
uugccgaacaacucgccgagcagguuccgggugcuggccuggcggccgcguccggaaaaggucucggccagguugaggcgg

SEQ ID NO: 58074 - RNA, 92 nt, Pseudomonas aeruginosa PA01
uuguaaggggucgguucgcgcaggucggcgcgggugaucuugccguuguagcgcucgcccaugccauagaucaccgucggaucggucugcaa

SEQ ID NO: 58075 - RNA, 76 nt, Pseudomonas aeruginosa PA01
uuggucaucucgacgcgcuuggccaugauugagccggcgguaccgccgaccagcaggccgacgacgauguagccga

SEQ ID NO: 58076 - RNA, 65 nt, Pseudomonas aeruginosa PA01
uuguccagccauucgcgguagaccaccaccgccagcggcaggcugccgccgauggccuuggacag

SEQ ID NO: 58077 - RNA, 56 nt, Pseudomonas aeruginosa PA01
uuguggaacacgucgauguuggcgcccaucaggcggccggcgucgaaguucggcag

SEQ ID NO: 58078 - RNA, 71 nt, Pseudomonas aeruginosa PA01
uuguggcuguugcucgguguggcauugcugggcacgcccucaacgcgcgcaaccgacggcaggguuugcaa

SEQ ID NO: 58079 - RNA, 86 nt, Pseudomonas aeruginosa PA01
uuuucccuucuuuuucaagcggcuagaucagcucaggucucuuuuagcaugcugaucagucuuugaacagguccaagaaggggaaa

SEQ ID NO: 58080 - RNA, 59 nt, Pseudomonas aeruginosa PA01
ggagcuguuucucguggcccugcgccgcgaggugcgcaagcucgacgagaacggcaucc

SEQ ID NO: 58081 - RNA, 59 nt, Pseudomonas aeruginosa PA01
ggaggaaggcggugcggaccuucggcuugagcccgucgagcauccgcgagauuuccucc

SEQ ID NO: 58082 - RNA, 97 nt, Pseudomonas aeruginosa PA01
ggagcguugcgaguugcccuacgaccuggccggugugucucgcgaccaggcgcugauccgccugcgcggcaccugccgggcagccaccaccgacucc

SEQ ID NO: 58083 - RNA, 63 nt, Pseudomonas aeruginosa PA01
ggagccguugcagugguagcacucgcgguuguucucgaucaccagcuuccaguuggcggcuuc

SEQ ID NO: 58084 - RNA, 72 nt, Pseudomonas aeruginosa PA01
ggagcagucggcaggcgagguacaccgggacuauauaaaggaaggcguagcucaggcuggcagcgacgcucc

SEQ ID NO: 58085 - RNA, 80 nt, Pseudomonas aeruginosa PA01
ggagugcguggaucgucgccguggcgaucugucucauggucggggacgcgaccgccgcuggcuggcguucggcaaacuuc

SEQ ID NO: 58086 - RNA, 89 nt, Pseudomonas aeruginosa PA01
ggagucgcagcgccagcgggcgcggagccacucccuggcgccgcugaugagcggcaacggcaagcgcuccggcggcuggaagcgacgcc

SEQ ID NO: 58087 - RNA, 57 nt, Pseudomonas aeruginosa PA01
ggagguccgucaugccgcucgagcaacauccgcuuucccgggaguuuccggauuuuc

SEQ ID NO: 58088 - RNA, 129 nt, Pseudomonas aeruginosa PA01
ggagugggcgcaagcgcucgaagaggcuggagugggugagauuuuucuaaauucuauugaucgagauggagugcagaaaggcuucgacaacgcucuaguggaaaauaucgcuucuaacguccaugugcc

SEQ ID NO: 58089 - RNA, 68 nt, Pseudomonas aeruginosa PA01
ggauggucucuuccaucaccgagcgcaggaucucguccuugcucuugaagugauggaagaugcugccc

SEQ ID NO: 58090 - RNA, 110 nt, Pseudomonas aeruginosa PA01
ggaugucggccagggccaucugcgcggcgacccgcucgccgucguugcucgccgcgacgccggcgaggaaaucgccggagcgcgcggggcuggccuuggccaucacgucc

SEQ ID NO: 58091 - RNA, 63 nt, Pseudomonas aeruginosa PA01
ggaugcgccgcaggucggcgccguagacccggaggauuccggugcggacgauaugcgugcccc

SEQ ID NO: 58092 - RNA, 62 nt, Pseudomonas aeruginosa PA01
ggaugcggaugcgcuugucgcgggcguucuugugccgcgacuugaacagccagccguagacc

SEQ ID NO: 58093 - RNA, 60 nt, Pseudomonas aeruginosa PA01
ggaugcgguggccccaccagagcuggcggcugaugcaccaguccuggaugucgcgcaucc

SEQ ID NO: 58094 - RNA, 105 nt, Pseudomonas aeruginosa PA01
ggaugcuggcgauauccuucaaccgcucggccugggccgcgccggcggccaggagcagcgcggcgagggccagcaggugcuugaacuuggucaucgcgagcgucc

SEQ ID NO: 58095 - RNA, 76 nt, Pseudomonas aeruginosa PA01
ggauuucucgcuggcgcggcugcucagggcguaggccagggcgaggaacacgcagccgagcagcagcgaggaaccc

SEQ ID NO: 58096 - RNA, 93 nt, Pseudomonas aeruginosa PA01
ggcaacgccagcaccacgaugcuggucagcuuggcguuggugacgaacaucagcagcaccccgccgaccagcaucagggcauugcgcagggcc

SEQ ID NO: 58097 - RNA, 75 nt, Pseudomonas aeruginosa PA01
ggauacugcucaccacgguguucgucugccagcccaacuauggcgcgacccgccugcgccuggugcagcggaucc

SEQ ID NO: 58098 - RNA, 60 nt, Pseudomonas aeruginosa PA01
ggaucggcccucugcggcaggcgggugccgcucgccgccagcaggcggccgaggaacucc

SEQ ID NO: 58099 - RNA, 69 nt, Pseudomonas aeruginosa PA01
ggaucggugguguagacgccgucgacgucgguguagaucuggcauucgucggccuucaacgccgccgcc

SEQ ID NO: 58100 - RNA, 66 nt, Pseudomonas aeruginosa PA01
ggaucguagccuuggagaaaccguccucccaggagcagggccagugguauuuccagcgcuacaucc

SEQ ID NO: 58101 - RNA, 67 nt, Pseudomonas aeruginosa PA01
ggaugagcgcugcguggcgcccaacggccgccggaucaggguccgggccaggcacuacgugcucucc

SEQ ID NO: 58102 - RNA, 85 nt, Pseudomonas aeruginosa PA01
ggccgagauguucccgccggaggugcgcgcccucggcgucggaguguccuacgcggugggcaacgcgaucuucggcggcucggcc

SEQ ID NO: 58103 - RNA, 59 nt, Pseudomonas aeruginosa PA01
ggccgagcacgucggcuucgagcuggccuaccuggucuccgccggagccugugucggcc

SEQ ID NO: 58104 - RNA, 91 nt, Pseudomonas aeruginosa PA01
ggccgagcugauccgugccgccgccgaggcuucgcugcgcgacuacauuuccgcccagcgccgccugggccgcgacauccggcguucggcc

SEQ ID NO: 58105 - RNA, 88 nt, Pseudomonas aeruginosa PA01
ggccgaggcggucgccacugccggcaacucggcgaucccgcuggucaaggcgcugggccgccagguggcggcuggcgacgccgaggcc

SEQ ID NO: 58106 - RNA, 105 nt, Pseudomonas aeruginosa PA01
ggccgagggcggcgagcaggcgccggcgcugcgggcucagcggcuggccguccagcggcgcgacaccgagcagugccagcggucccucuuccgccgacagcggcc

SEQ ID NO: 58107 - RNA, 101 nt, Pseudomonas aeruginosa PA01
ggccgaggucaacuggguggcccaggagcagccggagaucgcugcgaagaccgacaagguguugcugcuuuccggcuuucucagccaccgccugaccggcc

SEQ ID NO: 58108 - RNA, 64 nt, Pseudomonas aeruginosa PA01
ggcccugcgcgagcgccugggucggcaggcgccccuggccgccgaccuggcgccgcgccuggcc

SEQ ID NO: 58109 - RNA, 127 nt, Pseudomonas aeruginosa PA01
ggccagcgcggugagcagcaucgucaggccgaccagggcgggcaccaguugcuggccgaaacgaccgagcagcaggccgcccagggucgcggugaggaugaaggccagcgaaccgaccgcgcguacc

SEQ ID NO: 58110 - RNA, 88 nt, Pseudomonas aeruginosa PA01
ggccagcucccccuggcggagcgccaggcggcguugcagcggcuggccgccgcagcgcccugacgccugcucaggcggcgagcugguc

SEQ ID NO: 58111 - RNA, 66 nt, Pseudomonas aeruginosa PA01
ggccagcgccgccgccagaucgaucaucgccaucgcggugccggggcaggcgcggucgccgaggcc

SEQ ID NO: 58112 - RNA, 67 nt, Pseudomonas aeruginosa PA01
ggccacgaccgucccuggguguucgcccgcagcguggcggcgcgcagcgcccuggaaggcucgggcu

SEQ ID NO: 58113 - RNA, 78 nt, Pseudomonas aeruginosa PA01
ggccacguugcugcuuucgaagcgcucgcgcccgccgaccccgcgcaggcugucgaggacgaacgcggcgaacaggcc

SEQ ID NO: 58114 - RNA, 56 nt, Pseudomonas aeruginosa PA01
ggcccagaccgaauugcggggccggcguccaguagcgcgccagcagcgguucggcc

SEQ ID NO: 58115 - RNA, 58 nt, Pseudomonas aeruginosa PA01
ggcccagcuggaaggccagcucgcggcccugguacggcugcgcgccgaccagcggguc

SEQ ID NO: 58116 - RNA, 65 nt, Pseudomonas aeruginosa PA01
ggcccaguucgccgccgccguugcgacuguccgggaacagccaguggcgcggggcgagcugguuc

SEQ ID NO: 58117 - RNA, 79 nt, Pseudomonas aeruginosa PA01
ggccaggucgucgcgcaggaugcgcuccagcucgccgcccaggucgcgggaaaucaggcgcuccucgaugauguggacc

SEQ ID NO: 58118 - RNA, 65 nt, Pseudomonas aeruginosa PA01
ggccagucgcugcgagccagguucaggcccuugaacagugccuugccggcgccgcagagcuggcc

SEQ ID NO: 58119 - RNA, 55 nt, Pseudomonas aeruginosa PA01
ggccaugaggcggcggcgcugugccugcuggcggcggccgcccuccucaugugcc

SEQ ID NO: 58120 - RNA, 76 nt, Pseudomonas aeruginosa PA01
ggcaccguccgccgcguuccacuccagcgccugcauuucgccacgcggcuggcagcgcgcggccucggcgguggcc

SEQ ID NO: 58121 - RNA, 80 nt, Pseudomonas aeruginosa PA01
ggcaagucguucagauacccauguuggccaggcucugcacgauggagcggagcgugccggcgagggucggguggcugacc

SEQ ID NO: 58122 - RNA, 77 nt, Pseudomonas aeruginosa PA01
ggcaauggccggccguagggaaucgaacgccagugcggcggcaccguaucgacgcucugcagguucgaccagaugcc

SEQ ID NO: 58123 - RNA, 76 nt, Pseudomonas aeruginosa PA01
ggcacgcagcgcaugcucguagccggcgcugucgaaagcgcggucggcggcgagcauggcguugaucucgugggcc

SEQ ID NO: 58124 - RNA, 82 nt, Pseudomonas aeruginosa PA01
ggcacggacgccggcuacgccuacgugcccggcagcgacaaaccggcggugcuggaaacccucggcguggucggcgccggcc

SEQ ID NO: 58125 - RNA, 73 nt, Pseudomonas aeruginosa PA01
ggcagcgccggcgacgugcugcgccuucuggagguccuucgccagggcggcgcgccguugcugacgccuggcc

SEQ ID NO: 58126 - RNA, 92 nt, Pseudomonas aeruginosa PA01
ggcagcgcgacggugccacgccgagccuggccgcggccaggcgauagccauccggagccggcuugccguggaccacgucgucgcggcugacc

SEQ ID NO: 58127 - RNA, 58 nt, Pseudomonas aeruginosa PA01
ggcaggccggguugauggccaggaugcgcgccgccaucaccucgaccuuggccuugcc

SEQ ID NO: 58128 - RNA, 69 nt, Pseudomonas aeruginosa PA01
ggcaggcguuucuucagcagcccgaggcugccgaugauuaccgucagcagguuguugaagucgugggcc

SEQ ID NO: 58129 - RNA, 57 nt, Pseudomonas aeruginosa PA01
ggcauccgccugcgacaguucccauccaggccacaguugaugggcgaggcggaagcc

SEQ ID NO: 58130 - RNA, 72 nt, Pseudomonas aeruginosa PA01
ggcaucgacguggaucaccgugccacgcuggguggucagcgacaccccgcggaugagcccgcgaucgauguc

SEQ ID NO: 58131 - RNA, 89 nt, Pseudomonas aeruginosa PA01
ggcaguccgucgaccggauagcccugcuggcgcagggcacgaaggauguucagcgccgccgccgggguguccaggccgacgccauugcc

SEQ ID NO: 58132 - RNA, 67 nt, Pseudomonas aeruginosa PA01
ggcaguuggauaccgcgacgaacuugccgucggcauccugcaggccgaucucgcggauccagaagcc

SEQ ID NO: 58133 - RNA, 94 nt, Pseudomonas aeruginosa PA01
ggccaaggccagccccgcgcgcuccggcgauuuccucgccggcgucgcggcgagcaacgacggcgagcgggucgccgcgcagauggcccuggcc

SEQ ID NO: 58134 - RNA, 90 nt, Pseudomonas aeruginosa PA01
ggcgaggucgccuuccccggcgggcggcgcgacccggaagaugccgaccuggugcgcaccgcccugcgcgaggcggaggaggagaucgcc

SEQ ID NO: 58135 - RNA, 56 nt, Pseudomonas aeruginosa PA01
ggcgaucggcauggaugggguggagauccacggcgcccacggcuaccugaucgacc

SEQ ID NO: 58136 - RNA, 55 nt, Pseudomonas aeruginosa PA01
ggcgcacgucggcgaucuccggagccaccgugagccccgagccgccgacgugguu

SEQ ID NO: 58137 - RNA, 60 nt, Pseudomonas aeruginosa PA01
ggcgccggcagguccaggcgcuccagcggcacacgcgugccggcgccggccugcggcgcc

SEQ ID NO: 58138 - RNA, 74 nt, Pseudomonas aeruginosa PA01
ggcgccggccaggccccggucgauggccuugagcagcagcguacuggcguuuuccgcggccuggccccaggccc

SEQ ID NO: 58139 - RNA, 56 nt, Pseudomonas aeruginosa PA01
ggcgccggccgucguccucgaagucgcaggcgagcacuucgcgguugucggcgacc

SEQ ID NO: 58140 - RNA, 70 nt, Pseudomonas aeruginosa PA01
ggcgccgggcuugagcuggauauacgccaccggcagcucgccggccuuggcguccggcuugcccaccgcc

SEQ ID NO: 58141 - RNA, 87 nt, Pseudomonas aeruginosa PA01
ggcgccgaaggggacaccccgcugcuguuuuccgaccgugcccggcgcggggcggagagccagccggaacugacccucgcgcgcgcc

SEQ ID NO: 58142 - RNA, 59 nt, Pseudomonas aeruginosa PA01
ggcgccacggugcuggagcacgcccgcgaugcggcccggcgcuuccugcaccuggcgcc

SEQ ID NO: 58143 - RNA, 67 nt, Pseudomonas aeruginosa PA01
ggcgccgucggccauuaccaggugacccugaaaguaggguuccguaucgccaauagcugauggcacc

SEQ ID NO: 58144 - RNA, 59 nt, Pseudomonas aeruginosa PA01
ggcgccgcgaugcaacucgacgcccagccaaaggcgcugggggaagcguucgcggagcc

SEQ ID NO: 58145 - RNA, 68 nt, Pseudomonas aeruginosa PA01
ggcgccuuggucaucgggguggaucgggcuagaaugccgcucccuuucacuuucgugaccguccagcc

SEQ ID NO: 58146 - RNA, 71 nt, Pseudomonas aeruginosa PA01
ggcgcgacagagugccgcaggugaaaacguuugcaacccuugcgggcuuucccccgccgcgcucuuccgcc

SEQ ID NO: 58147 - RNA, 56 nt, Pseudomonas aeruginosa PA01
ggcgcgaguugcugcgcgucuaccaucgccuggaagcgcgcggcgagauucgcggc

SEQ ID NO: 58148 - RNA, 70 nt, Pseudomonas aeruginosa PA01
ggcgcgcgcuggucgguccgggauuuccgcgagcuacggaucguccgcgaagacgaccggcuguacugcc

SEQ ID NO: 58149 - RNA, 60 nt, Pseudomonas aeruginosa PA01
ggcgcgcaggcgcagaacaccucgaccuucgcucucgacgaucucuccacgcugcgcgcc

SEQ ID NO: 58150 - RNA, 55 nt, Pseudomonas aeruginosa PA01
ggcgcgcaggcugaagaaggcgcgcccgucgggcuguuccuucagcgaugcggcc

SEQ ID NO: 58151 - RNA, 72 nt, Pseudomonas aeruginosa PA01
ggcgcucaggcgcguggcccagcaggagggggcuacugccuucgcccuguugcuggcuucguuccaggcgcu

SEQ ID NO: 58152 - RNA, 95 nt, Pseudomonas aeruginosa PA01
ggcgcucgcgcggcaggccgggcuccagcucggcgaggucggccaggcgcucggcgccgagcaauucggcgagcagggcggcgccggcgguaucc

SEQ ID NO: 58153 - RNA, 89 nt, Pseudomonas aeruginosa PA01
ggcgcugcagggugcgcggccgguagccgaaggugaacaucugcuggcgggucagcacuacgcgcaccgaccgccgcaguugcagcgcc

SEQ ID NO: 58154 - RNA, 100 nt, Pseudomonas aeruginosa PA01
ggcgcggcaggaagcucagggucuguucguugaucuggguggcggccuggaacaucgccaccacgagaccgaccagcaggcucggaaccaccagcacgcc

SEQ ID NO: 58155 - RNA, 55 nt, Pseudomonas aeruginosa PA01
ggcgcggcucguggaucagcgcgcgagccagcgcgacgcgcugcuucugcccgcc

SEQ ID NO: 58156 - RNA, 67 nt, Pseudomonas aeruginosa PA01
ggcggagcggcuaggccugcaacugccgcagcggcgacugcgggaucgccagccgcaacuguucgcc

SEQ ID NO: 58157 - RNA, 60 nt, Pseudomonas aeruginosa PA01
ggcgcgggucgagcguggccaggucgccgcgauagccaccgggcuugcgcaggcccggcc

SEQ ID NO: 58158 - RNA, 69 nt, Pseudomonas aeruginosa PA01
ggcgcggucaccggccagccggucucggucugccaccaauggucguggaccggccgcccggugugcucc

SEQ ID NO: 58159 - RNA, 58 nt, Pseudomonas aeruginosa PA01
ggcgcugcuguuccaguacgcgguggcgauccagcaucugcgccuggacaaguacgcc

SEQ ID NO: 58160 - RNA, 129 nt, Pseudomonas aeruginosa PA01
ggcgcuggaaaccgaacugcgccgcgcccucgagcgcgacgaguugcagcucuacuaccaacccaagcugagccuggagagcggcuugcuggucggcgccgaggcacuggugcgcugguaccauccgcu

SEQ ID NO: 58161 - RNA, 56 nt, Pseudomonas aeruginosa PA01
ggcgcugggcuugaccccggcguagucguacucguugcugugcaccgcccagagcc

SEQ ID NO: 58162 - RNA, 74 nt, Pseudomonas aeruginosa PA01
ggcgcuucaagcagcgccugaaggaagucgacuaugaccuggugaucgacgcccaggggcugcugaagagugcc

SEQ ID NO: 58163 - RNA, 78 nt, Pseudomonas aeruginosa PA01
ggcggaucuucgccaguugcgcgagggugcgcgcgggaucgcgaucgaccagggcgcggccggcgaagaauuucugcc

SEQ ID NO: 58164 - RNA, 58 nt, Pseudomonas aeruginosa PA01
ggcggcaagcucggccugcgcaucgacgagaaccagcgcgugcagcucgcccucagcc

SEQ ID NO: 58165 - RNA, 77 nt, Pseudomonas aeruginosa PA01
ggcggccgugcagcgcuggugcgccgaggacuccgcuucgcaggggcugguccuggauaccggcaaugcgcgcuacc

SEQ ID NO: 58166 - RNA, 83 nt, Pseudomonas aeruginosa PA01
ggcggccuaucucgacauggaucggcuggucgcgcuggcccuggagcagggcugcgaggcgauccauccgggcuacgguuucc

SEQ ID NO: 58167 - RNA, 66 nt, Pseudomonas aeruginosa PA01
ggcggcgccguucggcaggcugcagaccuucguggugguugccggccugaucggcgcggcgcuguu

SEQ ID NO: 58168 - RNA, 130 nt, Pseudomonas aeruginosa PA01
ggcggcgccuggccgacuacaucgaaagccaccuggagcagccgcuggaacuggggucgcuggcggagcuggcggcgcucuccgaguaccacuucgcgcgcauguuccgcguauccuucggccugccgcc

SEQ ID NO: 58169 - RNA, 60 nt, Pseudomonas aeruginosa PA01
ggcggcgcuccucgaaggggaacggcagauugcgguagcccuccuccacguggcgccgcu

SEQ ID NO: 58170 - RNA, 80 nt, Pseudomonas aeruginosa PA01
ggcggcggcgacgccacuccucguuccaggcugaagucauuccgcucaguccugcagcagggugccgcgguugagccgcc

SEQ ID NO: 58171 - RNA, 90 nt, Pseudomonas aeruginosa PA01
ggcggcggcggcgagguccuggcggccguagccgagguuggugcaccagaggccggacaugccguccagguagcgcuugccgucguuguc

SEQ ID NO: 58172 - RNA, 76 nt, Pseudomonas aeruginosa PA01
ggcggcggugcgcggggucgcggugaagagccuggacuaccuguucguggcccuggugacccuggucaccgucgcc

SEQ ID NO: 58173 - RNA, 63 nt, Pseudomonas aeruginosa PA01
ggccgcagcgggcaggccgccuggcgcccgaccccauccggcuuccggcggccucccgcggcc

SEQ ID NO: 58174 - RNA, 60 nt, Pseudomonas aeruginosa PA01
ggccgccgcguggcgucggagucucgccgaacgcaggacggccugcgcccgcgaucggcc

SEQ ID NO: 58175 - RNA, 56 nt, Pseudomonas aeruginosa PA01
ggccgccgagccaggccucgcguaucacgcugaucgguagcggcucggcgaaggcc

SEQ ID NO: 58176 - RNA, 71 nt, Pseudomonas aeruginosa PA01
ggccgccgcccgccuggguagcuacguggcggcggcgaaagcccugcacguaacccagccggcggucggcc

SEQ ID NO: 58177 - RNA, 79 nt, Pseudomonas aeruginosa PA01
ggccgccugaguuucccgagcgcaugaaaaagcccggcauccgccgggcuuucucguuaccgccggcucauugcuggcc

SEQ ID NO: 58178 - RNA, 60 nt, Pseudomonas aeruginosa PA01
ggccgcgaagugacguaggccagugccaucugcgccgguuccaguccauguucgcgggcc

SEQ ID NO: 58179 - RNA, 58 nt, Pseudomonas aeruginosa PA01
ggccggagcggcccucgauccgcugguggaguucuaccggccgaucccgccguuggcc

SEQ ID NO: 58180 - RNA, 78 nt, Pseudomonas aeruginosa PA01
ggccggcaggaucaggauguacaccucgggauggccccaggcccagaagagguugauguacaucauggcguugccgcc

SEQ ID NO: 58181 - RNA, 70 nt, Pseudomonas aeruginosa PA01
ggccggccuggcgccggcuucggcauacaucugccucgaacacgccgagcaccuggcgcccggccuggcc

SEQ ID NO: 58182 - RNA, 56 nt, Pseudomonas aeruginosa PA01
ggccggcgacgguggccgaggucaaccaggaguggcuggccgacucguagccggcc

SEQ ID NO: 58183 - RNA, 56 nt, Pseudomonas aeruginosa PA01
ggccggcggcgugccagaggcagaguucgucgaagaagaaagcgguacgucggguc

SEQ ID NO: 58184 - RNA, 61 nt, Pseudomonas aeruginosa PA01
ggccgggauuuccugcaacugcgccaggcccaguugggcacgcaauugcucgggacuggcc

SEQ ID NO: 58185 - RNA, 55 nt, Pseudomonas aeruginosa PA01
ggccgggacgaagccggggaaaucgaaggcauuggccacccccucuuccuuggcc

SEQ ID NO: 58186 - RNA, 83 nt, Pseudomonas aeruginosa PA01
ggccgguggugucauuggcagccaucgcgcgaccgcuggcggcgaacgggaaggugccgacguugacuucgacgcccucggcc

SEQ ID NO: 58187 - RNA, 81 nt, Pseudomonas aeruginosa PA01
ggccgguucgaagcgcgccagcagguggcggauggcggccugcacgccggccaucaccgccagcuggugcgccuugagguc

SEQ ID NO: 58188 - RNA, 76 nt, Pseudomonas aeruginosa PA01
ggccguccuggcgguuguccaggcugcucgccucgacccgcaguucgcccucggcgagcagcuugccgccacgguu

SEQ ID NO: 58189 - RNA, 58 nt, Pseudomonas aeruginosa PA01
ggccgucgcggcgagcgaucagcacggccugguagaaguccgccucgccgcugcgguc

SEQ ID NO: 58190 - RNA, 93 nt, Pseudomonas aeruginosa PA01
ggccgugcggcaagggcgucggccaggcgcaugccgccgcgcacgucgcugcgcacggcgcucagggucugggcgaugugcuugcgcucggcc

SEQ ID NO: 58191 - RNA, 70 nt, Pseudomonas aeruginosa PA01
ggcgaagaucggcgccucggcagccggggcggcaggcuuggccggggcggccggggcguucuucuucgcu

SEQ ID NO: 58192 - RNA, 69 nt, Pseudomonas aeruginosa PA01
ggcgacaggcgcggguacuggugcagcccgcacugcggacacugcaucacccgcucgugguccugcgcc

SEQ ID NO: 58193 - RNA, 63 nt, Pseudomonas aeruginosa PA01
ggcgacgccggcggcacccaguucgaccgcuucgacaucgcuggcgacccguccggccuugcc

SEQ ID NO: 58194 - RNA, 94 nt, Pseudomonas aeruginosa PA01
ggcgacuggcgcuccaggguggccagcgcgguacucgacggcagcagggaaaugcguucguugcuggugcugcgcagcagcgaggccggcagcc

SEQ ID NO: 58195 - RNA, 57 nt, Pseudomonas aeruginosa PA01
ggcgagcagcggcaggcugucgcgcagcagggcgccggcggccuugcgcagcuugcc

SEQ ID NO: 58196 - RNA, 57 nt, Pseudomonas aeruginosa PA01
ggcgagcuuggcggcgauggcguagggcacgccgcugcccauggucgccagcuugcc

SEQ ID NO: 58197 - RNA, 57 nt, Pseudomonas aeruginosa PA01
ggcgaggaagucgcagugcucgcgggucagccggcgcaugcccuugccuuccgcgcc

SEQ ID NO: 58198 - RNA, 68 nt, Pseudomonas aeruginosa PA01
ggcgaggaggaucgccgcgauccauaccgaggcgacgaaggggaucagcccggcgaucccgccuggcc

SEQ ID NO: 58199 - RNA, 58 nt, Pseudomonas aeruginosa PA01
ggcgagcuggaugccgcgcagugccuguacgggcuggucuacggcguccagcucggcc

SEQ ID NO: 58200 - RNA, 61 nt, Pseudomonas aeruginosa PA01
ggcgacccggacuucgccggcgccaagauccaccuggacguccgccgccgaauccuucgcc

SEQ ID NO: 58201 - RNA, 70 nt, Pseudomonas aeruginosa PA01
ggccucgcgccacagcgcguggagguucuccaggcgcacgucggggagcaccagguucuguucgugggcc

SEQ ID NO: 58202 - RNA, 56 nt, Pseudomonas aeruginosa PA01
ggccugggcggccaggacuacagcaucaacgcgcaguucaacggcagcccggcguc

SEQ ID NO: 58203 - RNA, 66 nt, Pseudomonas aeruginosa PA01
ggccugcccgggagcggugcgcucgaggucgacgagcagcacguguucgugagcgagaacaagguc

SEQ ID NO: 58204 - RNA, 72 nt, Pseudomonas aeruginosa PA01
ggccuuccuggccugcagcuuggccggguugaucaggaaacgcgccagggccggcagcagccagagggcgcc

SEQ ID NO: 58205 - RNA, 69 nt, Pseudomonas aeruginosa PA01
ggccuucgaggccgcaggccuggagugccugccggucccggucgacgaacagggccugcggcccgagcc

SEQ ID NO: 58206 - RNA, 120 nt, Pseudomonas aeruginosa PA01
ggccuugccgaucagcgacgagcugggcuucguccucggcgcgcuggugaucggcuggcaccucuggcgccagcgugcgcgcgaggcgguggcgugaucgcgcugugucugggcauggcc

SEQ ID NO: 58207 - RNA, 72 nt, Pseudomonas aeruginosa PA01
ggccuuguugaucaugccgcgguucucaggaguguccugaacuucgacgguaugauugaugcgacgcaggcc

SEQ ID NO: 58208 - RNA, 81 nt, Pseudomonas aeruginosa PA01
ggcuuuccaggccgccagccguucggccuugagcgccccgcagaccaguucguggccaagggcgauggcggccugcuggcc

SEQ ID NO: 58209 - RNA, 68 nt, Pseudomonas aeruginosa PA01
ggcuuucccgucgaugcggagcggauagccgcgauacgguuauccgcuccacucaacggggcgaggcc

SEQ ID NO: 58210 - RNA, 55 nt, Pseudomonas aeruginosa PA01
ggcuggaggcgccggguugccuggaguaccaggugcgcagggacgcccucgagcc

SEQ ID NO: 58211 - RNA, 57 nt, Pseudomonas aeruginosa PA01
ggcuuccauggugacgccggucugcgcgcugaacaggccgaacucgcccugggcguc

SEQ ID NO: 58212 - RNA, 55 nt, Pseudomonas aeruginosa PA01
ggcuucggcuccccagccggacgacgacgcgcgucugggacgggugcugaagacc

SEQ ID NO: 58213 - RNA, 63 nt, Pseudomonas aeruginosa PA01
ggcuucgucgagggaggcggucggcucgucgagcagcaggaucggccacucgaccaugaagcc

SEQ ID NO: 58214 - RNA, 87 nt, Pseudomonas aeruginosa PA01
ggcuuuuccgagagcgcccugcugagcagccuggacgccgccagcgggccggcccgggugauccuccagcauguccucgcggaugcc

SEQ ID NO: 58215 - RNA, 72 nt, Pseudomonas aeruginosa PA01
gggaaguagcgcccggcgcggcagcggucgcuccaggcggccagcaggaugcgcccggcgacgccgcugccc

SEQ ID NO: 58216 - RNA, 72 nt, Pseudomonas aeruginosa PA01
ggcuguccgucgacggcccgcuggcggcggcgauccccggccugccggcggcgcuggucgaauugagcagcc

SEQ ID NO: 58217 - RNA, 85 nt, Pseudomonas aeruginosa PA01
gggcaaccugaacagccagugcgcggugcugaccuggcuaccgaacaacgccacggaagcgauccgugccugguccagauagccc

SEQ ID NO: 58218 - RNA, 55 nt, Pseudomonas aeruginosa PA01
gggcagcuucagcaagcgcucggcgggguagagccgggcgcuggcauaggcgccc

SEQ ID NO: 58219 - RNA, 86 nt, Pseudomonas aeruginosa PA01
gggccgcugagguucaggccggcugccgccacucgcguagcaguucgaugaaggcgcgcagcuuggccgguacguggcggcgguuc

SEQ ID NO: 58220 - RNA, 65 nt, Pseudomonas aeruginosa PA01
gggccggagccgguucgcaccuauccgguggauaucgcgauccgugccuaugaucguuccggccu

SEQ ID NO: 58221 - RNA, 62 nt, Pseudomonas aeruginosa PA01
gggccuggccgacaugcccggcgccgaucccgaggugcgcgcggcgaucgaggccgaggccc

SEQ ID NO: 58222 - RNA, 60 nt, Pseudomonas aeruginosa PA01
gggccgcccggcgggaucuugcccugggcgacggucagcacuugccgcgcguggcggcuc

SEQ ID NO: 58223 - RNA, 82 nt, Pseudomonas aeruginosa PA01
gggcccggagcacgcgguggcggcuguggauauccucgccgaggacggcgagcgcagccuugccgcgcuguucgccgggcuc

SEQ ID NO: 58224 - RNA, 65 nt, Pseudomonas aeruginosa PA01
gggcaggugcgcccagcgcgcggucaugaagucgauggucuccaccgcgcgcagggcgacgaccc

SEQ ID NO: 58225 - RNA, 69 nt, Pseudomonas aeruginosa PA01
gggccagcggguugaucgagaaauaggcgcugcgguaccagcgcaccagggucgggccgcgcucggucc

SEQ ID NO: 58226 - RNA, 57 nt, Pseudomonas aeruginosa PA01
ggcucgcgagcgccagggcaacgaugcauuccucgcugccuuccugcucggcgagcc

SEQ ID NO: 58227 - RNA, 60 nt, Pseudomonas aeruginosa PA01
ggcucgcgcgggcugaccccgcuggacgguaucaccgcccugggcaugcuggugcuggcc

SEQ ID NO: 58228 - RNA, 56 nt, Pseudomonas aeruginosa PA01
ggcucgcucaugucgucgccuuccaccaguacgguguagagcgcggugaucgagcc

SEQ ID NO: 58229 - RNA, 74 nt, Pseudomonas aeruginosa PA01
ggcucuaccuggagcagcgcaaccugcagcgaguggcggacguggcggcgcuggagagugccucccagggagcc

SEQ ID NO: 58230 - RNA, 59 nt, Pseudomonas aeruginosa PA01
ggcuccgcgaacgcuucccccagcgccuuuggcugggcgucgaguugcaucgcggcgcc

SEQ ID NO: 58231 - RNA, 75 nt, Pseudomonas aeruginosa PA01
ggcugcaaccgcagcgcccgcgacuacccgcuggagcaaggcuacgugcggcuguucgaggcgcagguggcggcc

SEQ ID NO: 58232 - RNA, 82 nt, Pseudomonas aeruginosa PA01
ggcugcuccgcgccacgcccugguggcuauugcuggcgaucgucgcggcgaucgccuggcacgccacccggcgccugcugcc

SEQ ID NO: 58233 - RNA, 88 nt, Pseudomonas aeruginosa PA01
ggcuaugacguggucgaccucggcgugauggugccggcggagaagauccugcagaccgccaucgccgagaaaugcgacaucaucggcc

SEQ ID NO: 58234 - RNA, 76 nt, Pseudomonas aeruginosa PA01
ggcugccagcgccagcgaacaacugggcgacgucggaggcgucgaacagguagcgcugguugcagaacuggcaguc

SEQ ID NO: 58235 - RNA, 63 nt, Pseudomonas aeruginosa PA01
ggcugccgcccuugcggccgcgacugagaccgucgaggcggucgcgcagggcagccggcaguu

SEQ ID NO: 58236 - RNA, 60 nt, Pseudomonas aeruginosa PA01
ggcugcgaauuccccuaccggcgcaucgacgcgcuggagacccuggauuucgccgacgcc

SEQ ID NO: 58237 - RNA, 61 nt, Pseudomonas aeruginosa PA01
ggcuguaccucggcgcuggugcgauaucggcugcuggccaggggcgccagcgccgacagcc

SEQ ID NO: 58238 - RNA, 78 nt, Pseudomonas aeruginosa PA01
ggcgguguccgggcaguucggccucggcugccuggccagccuggcggucggcuggcuggcgcugcccggcgugcugcc

SEQ ID NO: 58239 - RNA, 61 nt, Pseudomonas aeruginosa PA01
ggcgguuguccaggcugcucgccucgacccgcaguucgcccucggcgagcagcuugccgcc

SEQ ID NO: 58240 - RNA, 97 nt, Pseudomonas aeruginosa PA01
ggcguccguggccagcggcgcggacaguugggaagacugguggcaacgcgccgcgcagaucccccggcuggccccgcugaaggcgcagcgcgacgcc

SEQ ID NO: 58241 - RNA, 86 nt, Pseudomonas aeruginosa PA01
ggcguuggcgcgucgccucguccagcguguggguggcauccaccacccgcuccgacaggggcaaggcgacccauuccgccggcgcu

SEQ ID NO: 58242 - RNA, 59 nt, Pseudomonas aeruginosa PA01
ggcgugccgaacacauagcugcgggugauauccgacugguagccguggaccuggcagcc

SEQ ID NO: 58243 - RNA, 75 nt, Pseudomonas aeruginosa PA01
ggcggcgagcaggccgcucuccucgccgaucgccacgcaggucgcgccggcggcacaggcggccugcacgccgcu

SEQ ID NO: 58244 - RNA, 81 nt, Pseudomonas aeruginosa PA01
ggcggcuggcugacguccaggccgaaccacuuuuccgagagcuuggcgaagcggccgucggccuugaucuucuccagcgcc

SEQ ID NO: 58245 - RNA, 64 nt, Pseudomonas aeruginosa PA01
ggcggcuguauucggccagcuucucccgguacgggaccagcgcgaacaggccgggauagccgcc

SEQ ID NO: 58246 - RNA, 92 nt, Pseudomonas aeruginosa PA01
ggcggcuucuccgggaagagggucaggccggcuggucggccggggguucgcugucgccggccggggccgcuucggcuuccgggcgggccgcu

SEQ ID NO: 58247 - RNA, 55 nt, Pseudomonas aeruginosa PA01
ggcggcuugccgcccuccuccggagcgccacggagcaggucagcggcaugccgcu

SEQ ID NO: 58248 - RNA, 55 nt, Pseudomonas aeruginosa PA01
ggcgggcguuuccgcgcugacgauccgcgucgguaacgucgggacgcgcccggcc

SEQ ID NO: 58249 - RNA, 106 nt, Pseudomonas aeruginosa PA01
ggcgggcuuuccucgaaacgcagcugcgccuugccggcggcagcggugccgugggcggggccgcggcgccgcucugccgcaucgacgguugcgccugaaucccgcc

SEQ ID NO: 58250 - RNA, 79 nt, Pseudomonas aeruginosa PA01
ggcgguagccauggcuggggucgaccuuguugucggucuccagcagcgaguagccgauccccggcaucaggaagcugcu

SEQ ID NO: 58251 - RNA, 111 nt, Pseudomonas aeruginosa PA01
ggcggugccagaagccagugauacguugcagcagggccucguccagcgccaggccgaacucuccggccagggccucgagacucugccggugcaacuggucgaggugcugcc

SEQ ID NO: 58252 - RNA, 84 nt, Pseudomonas aeruginosa PA01
ggcggugcucgaggcgguggcgauccagcccggcgcgacgcuguucaccgugaugccgcucuucgccaccuccagcgcgaggcc

SEQ ID NO: 58253 - RNA, 55 nt, Pseudomonas aeruginosa PA01
ggggcucgccgaucaccccgguggaauauggcagcaccgaagucucggcgacccc

SEQ ID NO: 58254 - RNA, 89 nt, Pseudomonas aeruginosa PA01
ggggucauggguugcucgugucggucgcuuuucuaaugcgaaucaaucgcggucaugagcacuacacgaagcggcgccggauuuaccuc

SEQ ID NO: 58255 - RNA, 129 nt, Pseudomonas aeruginosa PA01
gggucagcgggcgcgucuggaaguucgggucggccucgaagucgcggaugucggcgacgaagaauucgaucucuucgcggagcagggcgcggcugagcuuuucccaguuguccacguccaggcugaucu

SEQ ID NO: 58256 - RNA, 57 nt, Pseudomonas aeruginosa PA01
ggggugauccagcucaccggcguggccagccgcuacgucggccuguggaucgccgcc

SEQ ID NO: 58257 - RNA, 81 nt, Pseudomonas aeruginosa PA01
gggucgaggcgucgagcaggccgaccgccucgcgcacugcgcggcauucgcgggccacggcggcgugcauguccucgcccc

SEQ ID NO: 58258 - RNA, 108 nt, Pseudomonas aeruginosa PA01
gggucgccaccuggaccagcccuucgcccuggcgggugaccagcacgucggccuucaggcggcgcugcuggccgugcaggucgagggugaagucgagcuucucgaccc

SEQ ID NO: 58259 - RNA, 102 nt, Pseudomonas aeruginosa PA01
gggucgccagcagcgcaccgaucugcgcgucgacguagcugcaggcgccgaaguaggcacgccgggcggcgcggaugcgcuccucgggcaacggcuuguccc

SEQ ID NO: 58260 - RNA, 69 nt, Pseudomonas aeruginosa PA01
gggcgguuuccucgaugucgccgcccuugguggcgcgcgccgaguugaugucgauggaaaccagggccu

SEQ ID NO: 58261 - RNA, 62 nt, Pseudomonas aeruginosa PA01
gggcgaggaagccgccggcgucgacuucgccggucaaccggcgcgcgcggcgcuccucgccu

SEQ ID NO: 58262 - RNA, 56 nt, Pseudomonas aeruginosa PA01
gggcgaggucgacaacggcgucgccugccccgccgggcaccgcuucgaccgcgccc

SEQ ID NO: 58263 - RNA, 88 nt, Pseudomonas aeruginosa PA01
gggcggagaucggccuggagcgcggccaggccuucagcgaauucagccgccaggucaccuauggccagcgcaccgccgacgaccgccu

SEQ ID NO: 58264 - RNA, 121 nt, Pseudomonas aeruginosa PA01
gggcuggcugcuugcggaagacgguggggaacggcuucucgugggacgcgcgcuugcaaagaaggaaaggcuccucuggaaccguucgaaccgccucagguuccuccccagcggccagcuc

SEQ ID NO: 58265 - RNA, 98 nt, Pseudomonas aeruginosa PA01
gggcugggaaagcgugcugcugcucggcggcggccugccccuggcgagccugccgcugcucugggcaugccugccggagucggugcgcuuccucgccc

SEQ ID NO: 58266 - RNA, 64 nt, Pseudomonas aeruginosa PA01
ggggccugggagaucgcccggcgcaccgaggaauacgccaagggcaugcugguccccggcaccc

SEQ ID NO: 58267 - RNA, 60 nt, Pseudomonas aeruginosa PA01
ggggcgggaaucgccuucugcucguugacgauauagucguggcagaugcgauccagcucc

SEQ ID NO: 58268 - RNA, 79 nt, Pseudomonas aeruginosa PA01
gguaggccgcgcuuuccggcuccaguugccagagaaaccacugucgcuccugggcauaggagagccgcaggggcucgcc

SEQ ID NO: 58269 - RNA, 64 nt, Pseudomonas aeruginosa PA01
ggguuggugcaugggguucucccguauccagaucgauugacgggagcaacgcuaugcccggcgc

SEQ ID NO: 58270 - RNA, 98 nt, Pseudomonas aeruginosa PA01
ggucacgguaagggcuguugcggcccggcucggugagggugccgcgguauucgcgcauuuccucgggaccgaggucgcagacgaacgccuugccggcc

SEQ ID NO: 58271 - RNA, 69 nt, Pseudomonas aeruginosa PA01
gguagugccggugggcuggaagguccggcuguagucgagcccgaugcgccagcccugcuugcgcgcgcc

SEQ ID NO: 58272 - RNA, 63 nt, Pseudomonas aeruginosa PA01
gguaugcgcgcccuucugucccaucuugcgauccggcuugcccagggacagcccgggcguacc

SEQ ID NO: 58273 - RNA, 55 nt, Pseudomonas aeruginosa PA01
ggucagggugaagccgucgguggcgccauagggcguacggcacagcgccuugucc

SEQ ID NO: 58274 - RNA, 73 nt, Pseudomonas aeruginosa PA01
ggucagcagcgagccgcacacgcccagcagcgaugcgcccagcagcaacuggcggugcgggcgggugcgggcc

SEQ ID NO: 58275 - RNA, 115 nt, Pseudomonas aeruginosa PA01
gguccgcgagcgcuucugguagcggaacagcgagccgacgccggggaggcuggagaguccgggaacgccgucgguguuguccugcacguuguccugcaacaggccgccgaggacc

SEQ ID NO: 58276 - RNA, 116 nt, Pseudomonas aeruginosa PA01
gguaccagcagccuguggcugaccggcagccuggucggcaagccggcagcggucuucaccuccaccgccagccugcacggcggccaggagaccacucaguuaucgaugcuguugcc

SEQ ID NO: 58277 - RNA, 58 nt, Pseudomonas aeruginosa PA01
gggugggauugcccugcaaggcuagcguaccuucgcaguuuggcauggcaacccaguc

SEQ ID NO: 58278 - RNA, 59 nt, Pseudomonas aeruginosa PA01
gggucuguucgaccaacugcgggguacugugcaucucgacgcuguucuggaucggaccc

SEQ ID NO: 58279 - RNA, 126 nt, Pseudomonas aeruginosa PA01
gggucggggcgcucgaaccagaagucggcgaagcgcugauggcggauguugccgacgcuguggugccaccaguagcuguccggaugcaccucgccgguguugucgauguuggcgaugcccucgccc

SEQ ID NO: 58280 - RNA, 64 nt, Pseudomonas aeruginosa PA01
gggucguggcgaugucggcguggccgagcaguuccugcacggcgcgcaggucgccggacgacuc

SEQ ID NO: 58281 - RNA, 61 nt, Pseudomonas aeruginosa PA01
gugcccgagguccugcugggggcggguacccugauccacaccgagcaguuucucgaggcgc

SEQ ID NO: 58282 - RNA, 81 nt, Pseudomonas aeruginosa PA01
gugcaucgguugcaaggccugccaggucgccugcucggaauggaacgagcugcgcgacgaggucggccacaaccacggcac

SEQ ID NO: 58283 - RNA, 71 nt, Pseudomonas aeruginosa PA01
gugcuggccaagcaguucgacguggccgagggcaagaucgucccgcgccacgaggaacgcguggccagggc

SEQ ID NO: 58284 - RNA, 81 nt, Pseudomonas aeruginosa PA01
guggaaaugaagacccgccgcgaugcgcugguacugguguuccucgguuucuucgcagugguggugggcuaccuguucgac

SEQ ID NO: 58285 - RNA, 56 nt, Pseudomonas aeruginosa PA01
gugcugaacaugagcuggggcggcuucggcgcgcugcucuacaucgccuucggcgc

SEQ ID NO: 58286 - RNA, 84 nt, Pseudomonas aeruginosa PA01
gugcggccuuccagcacgcgcucguagccgauguagaccggcacgaagacgaucggccggcgcgagucacggaggaagcugcgc

SEQ ID NO: 58287 - RNA, 76 nt, Pseudomonas aeruginosa PA01
gugaccgccggcagcggugggccccacggcugcgaagcguuucgcggccugucccaucccccgccugcgcggucac

SEQ ID NO: 58288 - RNA, 74 nt, Pseudomonas aeruginosa PA01
gugaagagcagcggccugcuggaguacgcucucggcgccgaugccggcagccucaagcagguggucaucgguac

SEQ ID NO: 58289 - RNA, 60 nt, Pseudomonas aeruginosa PA01
gugagcgggaggaucgaauugcaggcggugcgcuucgccuauccgacccgucccgaacac

SEQ ID NO: 58290 - RNA, 62 nt, Pseudomonas aeruginosa PA01
gucuuucccggauggauggagacgcggccccguauuuccggccccauccauccgagagagac

SEQ ID NO: 58291 - RNA, 55 nt, Pseudomonas aeruginosa PA01
gucuggaccggcccggcgcgaggggguucagguggcgugccgggcgguccgcgac

SEQ ID NO: 58292 - RNA, 76 nt, Pseudomonas aeruginosa PA01
gucuacgcugcuucaaggagcacuagacuauguuggauacaaugaggaaagucuggcuuuugaaguucugugugac

SEQ ID NO: 58293 - RNA, 56 nt, Pseudomonas aeruginosa PA01
gucguugcaggcgcccggcgaggaacggcaucgccucgccggcgccaugcagcagc

SEQ ID NO: 58294 - RNA, 56 nt, Pseudomonas aeruginosa PA01
gucuccuggaggcuucgcucggccugccaguagaggaugagcagccccaggacgau

SEQ ID NO: 58295 - RNA, 74 nt, Pseudomonas aeruginosa PA01
gucugcagggccuugucggucaggggaauuucacgcuugagcugcuccggcgugaucagggucucguuggaggc

SEQ ID NO: 58296 - RNA, 128 nt, Pseudomonas aeruginosa PA01
gucgacgguggcaacgaggggacgcauggcaucggguccugcaacugaaacgggugccuaugguaaggcgcccgccgggcaagacccaagccgggucauucguccucgaaguuguacaugccggcggc

SEQ ID NO: 58297 - RNA, 78 nt, Pseudomonas aeruginosa PA01
gucgccggcgaggccuucagccugaucaccggcgccgaccuggcgcugcucgaccuggagcuggaggccuugcccgac

SEQ ID NO: 58298 - RNA, 72 nt, Pseudomonas aeruginosa PA01
gucgcuacgcagcccguuccagccgccggugaagaucgaccugaccgugcggcagaagggcaacaaggugau

SEQ ID NO: 58299 - RNA, 89 nt, Pseudomonas aeruginosa PA01
gucgcugagcaccucgcugaccagcuugcuguuggucgccugguucggcgccaugccgaagcgcugguucagggaggcgccguagcgac

SEQ ID NO: 58300 - RNA, 74 nt, Pseudomonas aeruginosa PA01
gucgaggaaguguucuucguccugcgaggcaagcucaagguggugcuggagaaggacggcgagcgcuucgagac

SEQ ID NO: 58301 - RNA, 75 nt, Pseudomonas aeruginosa PA01
gucgaggcgcucgucggugaccggcgagaccagccgacgcggcucgcugaagacgcuacgggugucccauucgac

SEQ ID NO: 58302 - RNA, 91 nt, Pseudomonas aeruginosa PA01
gucgaucaacuccaccuucgaccaguuggccgcggccggcgucgcccaugccaccccggcugcggcagcggcggaggucggcguggucggc

SEQ ID NO: 58303 - RNA, 55 nt, Pseudomonas aeruginosa PA01
gucgccaugccauccucgcgcugcuuuccgagcagggcgaggucagcguggacgc

SEQ ID NO: 58304 - RNA, 69 nt, Pseudomonas aeruginosa PA01
gucgcccagcgccagucgcugcucgccgaacguauccucggcucggugaacaaggugcuggccggcgac

SEQ ID NO: 58305 - RNA, 78 nt, Pseudomonas aeruginosa PA01
gucgcccaggucgcccggcucguuggucacggcgaucugcuuggucaggccggcgcccagggagucgguacgggcgac

SEQ ID NO: 58306 - RNA, 86 nt, Pseudomonas aeruginosa PA01
gucggcaucaucauggccagcgaguucgccuucugcgccacuccgggcggcagcggcgggccguugacccugauggcguugcuggc

SEQ ID NO: 58307 - RNA, 126 nt, Pseudomonas aeruginosa PA01
gucggcauuccccucgcggagaucgcucgcgcccugcagacccugccggcggggcgcagcccuagcgcggcggacugggcgcgccugucggcgcaguggaaggaggaucucaccgagcgcaucgac

SEQ ID NO: 58308 - RNA, 56 nt, Pseudomonas aeruginosa PA01
gucggcgauggccgccagggcgcgcuccagguugugcgcggugucgccaucgcgac

SEQ ID NO: 58309 - RNA, 128 nt, Pseudomonas aeruginosa PA01
gucgcgaaggcaccugggucgaacugggccucggccucggcgccgcggugcucggccugcuggugcuguggcugagcgcccgcggcgugacccggccgauccucggcgucgcccacaugcugcgcgac

SEQ ID NO: 58310 - RNA, 71 nt, Pseudomonas aeruginosa PA01
gucgcgagcugcgcgaagcgcuggacgcucuccuugccgacugggcgccgcgcaucgagcgcggccgugac

SEQ ID NO: 58311 - RNA, 96 nt, Pseudomonas aeruginosa PA01
gucggucucgucgcaggacaaccaugccaccgccgcgcccugcuccagcaggcgcaggcgcaacuggcagaggauggugcucuugccgaagccggc

SEQ ID NO: 58312 - RNA, 99 nt, Pseudomonas aeruginosa PA01
gucggugaccuggcuggcgucccagcucggcaggcuuuccggcacgggcgugccgggcaggcgcuggagcaugucggcggcggcagagcgggcauagac

SEQ ID NO: 58313 - RNA, 84 nt, Pseudomonas aeruginosa PA01
gucggugaggaagagcuggaagcugcgcuggucgcugggguugcgcucgcggcggaccagguuucuucccuccagcucgcggau

SEQ ID NO: 58314 - RNA, 68 nt, Pseudomonas aeruginosa PA01
guggcuggccucguggggguggacgccggcggugguaaacagccggccgcccucgucgaguucgccgc

SEQ ID NO: 58315 - RNA, 89 nt, Pseudomonas aeruginosa PA01
gugggacagggcgugccguccggcaucagggcguaguccgggauuuccccgacccguguccagccggucuucagguacagccguucggc

SEQ ID NO: 58316 - RNA, 57 nt, Pseudomonas aeruginosa PA01
gugggcgcgaccucggcugcgguuuucgccgggaagccggggccgggcuguggccgc

SEQ ID NO: 58317 - RNA, 78 nt, Pseudomonas aeruginosa PA01
gugggcgggcugcgccaggguguugccaggcagggccggcaggcgcgccaggugcagcgagaccaauaccgcgaccac

SEQ ID NO: 58318 - RNA, 67 nt, Pseudomonas aeruginosa PA01
guggggcuccugguugccgggagcggcucggcgaugugccgccgcuucccguggccaggaguguugc

SEQ ID NO: 58319 - RNA, 113 nt, Pseudomonas aeruginosa PA01
guggggcuggcugggcgaccgcagcggccagcgccuggccaucgugcgcuucggcgcgguaugcacggcgcugggcuucucgcugaucuucgucagccacagcuacgccuggc

SEQ ID NO: 58320 - RNA, 126 nt, Pseudomonas aeruginosa PA01
guggcgguggcuucgggauggacgcgggcguucaugcggacuccugguaggcagcggggccguccggucgacggcuacccuggaguccgggccguugcacagccugugccgacccgcgcaggccac

SEQ ID NO: 58321 - RNA, 106 nt, Pseudomonas aeruginosa PA01
guggccagggucccggcgggcuucgccgccggcagcgcggcauccggcgccguggcgcguugcaggcugagcacgccggcggcgcugcggcuguauuccaggccgc

SEQ ID NO: 58322 - RNA, 128 nt, Pseudomonas aeruginosa PA01
guggcauugcuggaccgcaauaccaagccgcucaaacccaccgccagcggacugcgggucuacgaacagugccggcgggugcugcgcgagguggauggccugcgugaacugguggccggugacgccac

SEQ ID NO: 58323 - RNA, 89 nt, Pseudomonas aeruginosa PA01
guggcaagauccaccgcuucgcccugagcaacccgcacccggaaaucuccuggagcgcgcucuggggcaaggucugguacgagagcuac

SEQ ID NO: 58324 - RNA, 129 nt, Pseudomonas aeruginosa PA01
guguucgucguggaggaggcgaucggcucgcggcggccgagcgacaaggcgcuggccguggagcggaugcgccaggccggggcgaugaucgugucgcgggagauggucgccuucgaauggauggaacgc

SEQ ID NO: 58325 - RNA, 70 nt, Pseudomonas aeruginosa PA01
gugguuccgggcgggcgcccugccgaggcuggggcggcgucucgcuugguacgggcgcgcgacggaccau

SEQ ID NO: 58326 - RNA, 69 nt, Pseudomonas aeruginosa PA01
guugcaggcucgcucguucagcuuuccagcggcaccucuaugaggaagcggaacagcgcgccaugcugc

SEQ ID NO: 58327 - RNA, 114 nt, Pseudomonas aeruginosa PA01
guugcagggccggcggcgguagaccgcgcagcagcgcgcggaagcugucguccagccccuggcaguagcgcuccaggcgugccagcgccggcugcccgucgccugccgugcagc

SEQ ID NO: 58328 - RNA, 57 nt, Pseudomonas aeruginosa PA01
guugcaugaacggcgugccguucugggugaccaggaugccacccucguucaggcagc

SEQ ID NO: 58329 - RNA, 56 nt, Pseudomonas aeruginosa PA01
guugcccuucugccgcacggucaggucgaucuucaccggcggcuggaacgggcugc

SEQ ID NO: 58330 - RNA, 70 nt, Pseudomonas aeruginosa PA01
guugccgccagcuguagcgcaggcguugaugccgcaccaccagcgccucgcgcucggcaugacgcgcgac

SEQ ID NO: 58331 - RNA, 83 nt, Pseudomonas aeruginosa PA01
guugccggccucgcgggcgcggucgaggaucagcucggccaccgccgggguguccagcaccggccggguguagggcgggcagc

SEQ ID NO: 58332 - RNA, 65 nt, Pseudomonas aeruginosa PA01
guugccggcgcgccagaccaccuggucgccagucaccagugccggcagguuggcgcgcaggugac

SEQ ID NO: 58333 - RNA, 75 nt, Pseudomonas aeruginosa PA01
guugaccagguagugcaggccgcgccaggcgcuuuccaguugcuggaagucggcguggugcaugaucagguugac

SEQ ID NO: 58334 - RNA, 102 nt, Pseudomonas aeruginosa PA01
guugagcacguugaagcuggccacccgcaggcgcccuuccaccgccggcugggccggacgcggauuggccgccucgaaggucggcgucugcaacggcuggau

SEQ ID NO: 58335 - RNA, 95 nt, Pseudomonas aeruginosa PA01
guucggcgaggaaggugcggcucuucagcccggagagcuuuuccgccucgauguaguucaggucgaagaaguugcgcccgaccgcguuccagaac

SEQ ID NO: 58336 - RNA, 65 nt, Pseudomonas aeruginosa PA01
guucgucgagcagggccgccggcgccggcggaaccaggcgcgcaucgcggaccugcuccucgagc

SEQ ID NO: 58337 - RNA, 70 nt, Pseudomonas aeruginosa PA01
guucuccggcgccaaguucgcccugcgugcccuggcccagagcauggcgcgcgagcuggggccgaaggac

SEQ ID NO: 58338 - RNA, 67 nt, Pseudomonas aeruginosa PA01
guucugccaggccaacgaagccaacgaagccgucaaggaauucgucgcuccgcuggcacagcugaac

SEQ ID NO: 58339 - RNA, 78 nt, Pseudomonas aeruginosa PA01
guucgcgccgcccagccgcugcgccgccugcgccugcgcaacggcgcggagcgcuggucgcuguuccgcgacgugagc

SEQ ID NO: 58340 - RNA, 56 nt, Pseudomonas aeruginosa PA01
guucaggcugaccgggaugccuucguuggccagcucccaggcggucagucgcgagc

SEQ ID NO: 58341 - RNA, 56 nt, Pseudomonas aeruginosa PA01
guucgaccuccugcggcagguacucgaaauccaugccggccggcaggugaucgaac

SEQ ID NO: 58342 - RNA, 89 nt, Pseudomonas aeruginosa PA01
guucgacgagaucuucuccggcuucggcgagcagagcccggucaccccggugcgcgcccgcgagccggaggcgguggacaucgccgaau

SEQ ID NO: 58343 - RNA, 88 nt, Pseudomonas aeruginosa PA01
guucgccgauugccgcgaucuugaccuggcggcggaaaaggccgccuucggcauuuucuucaaccagggcgaggucuguucggcgaac

SEQ ID NO: 58344 - RNA, 82 nt, Pseudomonas aeruginosa PA01
guucgccguuucgcgccaggacaagcgcaaccccaacgacgccgaccggcugcgcaaguaccuggcgcguuucggccuggac

SEQ ID NO: 58345 - RNA, 80 nt, Pseudomonas aeruginosa PA01
guuccagcagcaacgcgaggcgcggaucgaguucaucaggaagcaauccuggaucgucggccgccuuggucagugggaau

SEQ ID NO: 58346 - RNA, 58 nt, Pseudomonas aeruginosa PA01
ggugguggcgcgcuuccaguagaucgcgccgaucagcgggaucagcaugccgccuacc

SEQ ID NO: 58347 - RNA, 55 nt, Pseudomonas aeruginosa PA01
gguggcgagaaucaggucgauccgcggcugcucccgggcgacccgcucgaccacc

SEQ ID NO: 58348 - RNA, 79 nt, Pseudomonas aeruginosa PA01
gguggcgcccggcuguaccgcuacgaucccagcgaugccucguggcagagcuggccgcugccggacagccaggcccgcc

SEQ ID NO: 58349 - RNA, 59 nt, Pseudomonas aeruginosa PA01
ggugggcgaugcgcgaggucagcgggguguagaugucgguguccucgugcacgucgauc

SEQ ID NO: 58350 - RNA, 85 nt, Pseudomonas aeruginosa PA01
gguggucgacuugcccgcuccguuggggccgaggagaccgacgaucucuccccggucgaugcggaagcucaagucguuuaccacc

SEQ ID NO: 58351 - RNA, 79 nt, Pseudomonas aeruginosa PA01
gguggucgaugcgaagagcgccaacgucgagggcuaugucaccgagcaggcccucgacgggcucuucgagaugaucgcc

SEQ ID NO: 58352 - RNA, 55 nt, Pseudomonas aeruginosa PA01
ggugcgcaccgucgagggcgaggaccucgacaucgccuucgacucggugugcauc

SEQ ID NO: 58353 - RNA, 79 nt, Pseudomonas aeruginosa PA01
ggugcugaugcucggcgacggagucaacgacguaccggugcucgccggugccgacaucagcgucgccaugggcagcgcc

SEQ ID NO: 58354 - RNA, 58 nt, Pseudomonas aeruginosa PA01
gguggcaggaugcgcagacuggagccccccaugugcgacacccugauccuucgccacc

SEQ ID NO: 58355 - RNA, 58 nt, Pseudomonas aeruginosa PA01
gguggccaguaccguggugcuguugcgcgcccuggagcagcgccaguugcuggacacc

SEQ ID NO: 58356 - RNA, 59 nt, Pseudomonas aeruginosa PA01
gguggccgaaccgcugcuggcgcgcuacuggacgccggccccgcaauucggucugggcc

SEQ ID NO: 58357 - RNA, 64 nt, Pseudomonas aeruginosa PA01
gguggccgaguucgcggccggugacgaggugaucgucaccggcuacgaccugggcaugaacacc

SEQ ID NO: 58358 - RNA, 121 nt, Pseudomonas aeruginosa PA01
gguggagacgaucugcuucgguuccagggucucgccguccaugaucgcgaacugcggcggccaguaggcgccggcgaugguguagcgguccucguagcccuugaacuuggagcuuuccacc

SEQ ID NO: 58359 - RNA, 65 nt, Pseudomonas aeruginosa PA01
gguggaggaggaagcgcgccagcaguugcugaacacggcgaagaugcccuucaucuucaagcacc

SEQ ID NO: 58360 - RNA, 58 nt, Pseudomonas aeruginosa PA01
gguguucgccgccggcggccuggacccgaccuucgucaucggcggccggcugaacgcc

SEQ ID NO: 58361 - RNA, 100 nt, Pseudomonas aeruginosa PA01
gguguugggcagcgccgccuugagcuugcgcaggcguucccacgggucuuccuugaggaagcgcacgcaggcgucgaagguggcgccgccccagacuucc

SEQ ID NO: 58362 - RNA, 94 nt, Pseudomonas aeruginosa PA01
gguucgauguugaugccgcgccagccgcgcucguagaacgccagggugaccgagucgauccgcgggugguuggcgccgacgucgauguagaacc

SEQ ID NO: 58363 - RNA, 63 nt, Pseudomonas aeruginosa PA01
gguugguggcggugugcgccgguuccgaccugaugcauccgaucggcgcgcuggcuaccggcc

SEQ ID NO: 58364 - RNA, 80 nt, Pseudomonas aeruginosa PA01
gguugccggugggcgagcccugcugggcgaaggcggcguacaggaugccuuugcccuugggcgcgcuuucgcuggcgauc

SEQ ID NO: 58365 - RNA, 61 nt, Pseudomonas aeruginosa PA01
gguugaacagcggcuggccggcggcguccggcgcgcagaccgccaccaguuguucgugacc

SEQ ID NO: 58366 - RNA, 81 nt, Pseudomonas aeruginosa PA01
gguugacccccgacgacgauccgcgcgaggugcucgguuuccucgacgagcgcagcgagcgcaaucuccugcuggucagcc

SEQ ID NO: 58367 - RNA, 103 nt, Pseudomonas aeruginosa PA01
gguugcggaauacgccgagcaauugcugcaggagcaccccgaagggguuuucaaccuggcgggauggucgcucggcggcaaccuggcgauggaugucgcggcc

SEQ ID NO: 58368 - RNA, 125 nt, Pseudomonas aeruginosa PA01
ggugaguuuccgcgggcgcuacgaggccccgcuuuccgcgccgggcagcggccguuugagcuggcagacguugcagagcggccuguucggcgggcaggccucgguccccgcggggagcauccgcc

SEQ ID NO: 58369 - RNA, 67 nt, Pseudomonas aeruginosa PA01
ggugaucgacaaccugaacgcgcggaucaacgccuggugggcgaugguccuggugaucgguuucgcc

SEQ ID NO: 58370 - RNA, 65 nt, Pseudomonas aeruginosa PA01
ggugagcgagcggccggacuucggcgagauccaggcgaucuugcgcgaccuugccgcucgcagcc

SEQ ID NO: 58371 - RNA, 123 nt, Pseudomonas aeruginosa PA01
ggugaucuuccugcacggcuggagcgugaugcagccggaccucuaccgcgccuggaucgaccauaucguccgccgcggcauggugguggucuacccacgcuaccagccggaccugaagacgcc

SEQ ID NO: 58372 - RNA, 60 nt, Pseudomonas aeruginosa PA01
ggugcgcggcgccucguccucgacccagaacuuggugcggaagaaggcgcgcguauagcc

SEQ ID NO: 58373 - RNA, 76 nt, Pseudomonas aeruginosa PA01
ggugcggcaguuccucuucuggcuggaggcgcgcagcccccaggccgcgcgcggcuagaggaagagucgcuucacc

SEQ ID NO: 58374 - RNA, 82 nt, Pseudomonas aeruginosa PA01
ggugcggccgggcaggccgccgaugcugaccucggccgggcggccggcguacugggcgucgagcggcuggucgggcuggauc

SEQ ID NO: 58375 - RNA, 55 nt, Pseudomonas aeruginosa PA01
ggugcggcgaaggcggcgaugaagaugaagaacaugccgaggaaaccgccgcacc

SEQ ID NO: 58376 - RNA, 55 nt, Pseudomonas aeruginosa PA01
ggugcggcgguuuccucggcauguucuucaucuucaucgccgccuucgccgcacc

SEQ ID NO: 58377 - RNA, 85 nt, Pseudomonas aeruginosa PA01
ggugcgggcgucggcgaguuccgcggagaucgcguugcuggcgcgcaggcguucgccgcgcugggcuucguugacgcuccgcgcc

SEQ ID NO: 58378 - RNA, 62 nt, Pseudomonas aeruginosa PA01
ggugccgccggacggucagccgaucguccugcucaacgaccggcagaccaucggcggcuacc

SEQ ID NO: 58379 - RNA, 93 nt, Pseudomonas aeruginosa PA01
ggugccggugcagauguagcugccgccguccgccgagcuggugaagaccaucuucgccaccgcugcgguggcguugucguaggcccgugugcc

SEQ ID NO: 58380 - RNA, 61 nt, Pseudomonas aeruginosa PA01
ggugcccuccacccgcgagaaacugcagugcggcagguagucgcggaacuggcgggcgucc

SEQ ID NO: 58381 - RNA, 56 nt, Pseudomonas aeruginosa PA01
ggugccagggcuacagcgagcccaacgccggcuccgaccuggccagccugcgcacc

SEQ ID NO: 58382 - RNA, 59 nt, Pseudomonas aeruginosa PA01
ggucgccgggucgucccagccacgggagaucauccaggcgcggaugcggcccagcgacc

SEQ ID NO: 58383 - RNA, 109 nt, Pseudomonas aeruginosa PA01
ggucgacggcgugcagguagcagccguccagcuugagguaggccagccccagauggguaagguugccgaucaggcugaagcggccgccgaaaugcugcaggccgagacc

SEQ ID NO: 58384 - RNA, 88 nt, Pseudomonas aeruginosa PA01
ggucgacugucccccgaggaccgcgcgcgcgccgggaucggcgacagccugauccgggucgcggucggccuggaagaccucgacgacc

SEQ ID NO: 58385 - RNA, 61 nt, Pseudomonas aeruginosa PA01
ggucgagcagcaggcgcacaggaugcacucguacagaccguccagcuucucgcgcucuucc

SEQ ID NO: 58386 - RNA, 100 nt, Pseudomonas aeruginosa PA01
ggucggagcgauccgccuggcgcugauguugcugaucgccaucgucaucgccguggcgaugaagaucgucggcguacugcugaucaccucgcugcugauc

SEQ ID NO: 58387 - RNA, 82 nt, Pseudomonas aeruginosa PA01
ggucgccgagggccuggcgccggaggucgcgucgcggcucgucgagcuugcccggcaggcuuucgaccaggccuucgucgcc

SEQ ID NO: 58388 - RNA, 88 nt, Pseudomonas aeruginosa PA01
ggucgccgccgacgcgccauuugugcaguucgccggguagcguauagcugguggcgagcuugaacagguggcguggcuuggccgcguc

SEQ ID NO: 58389 - RNA, 92 nt, Pseudomonas aeruginosa PA01
ggucgccgcgcugguguucuggcgcgugcugcccgagucgaaacacuuccggccggcaccgcugaagccggcgacccugcucaacggcuacc

SEQ ID NO: 58390 - RNA, 77 nt, Pseudomonas aeruginosa PA01
gguccaguucguagcgggagaucgccaguugauggcgcgagccguauucgcagaccuuuuccgagacguacuggacc

SEQ ID NO: 58391 - RNA, 118 nt, Pseudomonas aeruginosa PA01
ggucuugcagucgaugcagagggucgcgguggggcgcgccuccaggcgacggaugccgaucucgacgccgcaggagucgcaccagccguacucuucgucuucgaucaguugcaggguc

SEQ ID NO: 58392 - RNA, 73 nt, Pseudomonas aeruginosa PA01
ggucgugcagcguggccuucuccucggacagccagcgcugcuggagaaugucgcggcugcgcucgucgaggcc

SEQ ID NO: 58393 - RNA, 70 nt, Pseudomonas aeruginosa PA01
ggucguucccuggccuuccagcgugccgccuugcuggcgcagggcggcuugcaggaaggcuucggcgauc

SEQ ID NO: 58394 - RNA, 80 nt, Pseudomonas aeruginosa PA01
ggucgguggcgggaucguaguccucgcuggcgcgcugccccgaagcgacccggugauacacggcgaagaaugccaccgcc

SEQ ID NO: 58395 - RNA, 62 nt, Pseudomonas aeruginosa PA01
ggucggcggcgaugaggccgcgacccugcaccugcgcugcggcaacgacaucgcccacggcc

SEQ ID NO: 58396 - RNA, 55 nt, Pseudomonas aeruginosa PA01
guccgcucgaucuccgccuggcucaggugcggguugcgguugugguugagcaggc

SEQ ID NO: 58397 - RNA, 73 nt, Pseudomonas aeruginosa PA01
guccggcgaccagcggcgcguggcggucgcccucggggguuuccagcagcagcgugccgucggucagcgguac

SEQ ID NO: 58398 - RNA, 75 nt, Pseudomonas aeruginosa PA01
guccguacugggucuccaccggcgagcgccuguuguucuucgccggcaucugggaggccuauccggugcauggac

SEQ ID NO: 58399 - RNA, 69 nt, Pseudomonas aeruginosa PA01
guccucggugagcgccgaggagcagaccagcagcuggcagcucagggugcucaugaccgcggcgaggau

SEQ ID NO: 58400 - RNA, 60 nt, Pseudomonas aeruginosa PA01
guccagcgcagcaccagcucgccgccguagaccuggccaucgacgcucagcucguugggc

SEQ ID NO: 58401 - RNA, 60 nt, Pseudomonas aeruginosa PA01
guccagcgcgugcgccugccacgggugcucaccgccugccuggucggcgccgcgcugggc

SEQ ID NO: 58402 - RNA, 69 nt, Pseudomonas aeruginosa PA01
gucgacuacgcgcugauggagcgcucggacaaggucgccguggugcccugcuccaucggcuggagcgac

SEQ ID NO: 58403 - RNA, 75 nt, Pseudomonas aeruginosa PA01
gucgagcccgcgcuuguggcacucgugggcgauggcuuccucgaagucgcugaugaaguucaccgcggucuugac

SEQ ID NO: 58404 - RNA, 76 nt, Pseudomonas aeruginosa PA01
gucgacgccgagcaucucgcccuuggugacgcgcuccggguuguagcgggucagcagcagguguuccuugaucggc

SEQ ID NO: 58405 - RNA, 90 nt, Pseudomonas aeruginosa PA01
gucgacgccggagucgacccagggccgggcgcgcucgcggacgaaacgcaggguguccucgaaggcgccgcgggcgaucccggcgucgau

SEQ ID NO: 58406 - RNA, 72 nt, Pseudomonas aeruginosa PA01
guccuggucagccuguucucgcggcgcccgacgggugucgccagcgccgccugaaccaggcacaaccccgac

SEQ ID NO: 58407 - RNA, 70 nt, Pseudomonas aeruginosa PA01
guccuucccgcgcucggugggccagguuccgguuuacuacaaccaccugaacaccggccggccgauggac

SEQ ID NO: 58408 - RNA, 99 nt, Pseudomonas aeruginosa PA01
gucgaacagcaucaccugcggcuccauggccagggcgcgggcgaucgccacgcgcuguugcuggccgccggagaguucgcagggauacugccguucgac

SEQ ID NO: 58409 - RNA, 130 nt, Pseudomonas aeruginosa PA01
gucaucgccuugacccccgccaaccggccgaagcgcgcgccgggccuguucagggugcacauccagucacgcgccacgccgacguccucggcgcgcagccuggccuucuucucggcgguggugaggaugc

SEQ ID NO: 58410 - RNA, 71 nt, Pseudomonas aeruginosa PA01
guccacuucgcagcgcugcgcgagcagggugucgcgacgcggcgccugcucgaucagguugagcaccggac

SEQ ID NO: 58411 - RNA, 72 nt, Pseudomonas aeruginosa PA01
guagcaccgauggacgaggacgaggaugucgaggagaucaucuucucggcgcgcuucgccugcccggucugc

SEQ ID NO: 58412 - RNA, 103 nt, Pseudomonas aeruginosa PA01
guagaccgcgcggcccauaucgaacagcuugcgcuccacggcguaggccagggugcucuugccggcgccggagaggccgcugaacaguacggucgccggcugc

SEQ ID NO: 58413 - RNA, 127 nt, Pseudomonas aeruginosa PA01
guagagccccggcgcguuaccggcggcacgcggcgcgcgggcgucuuccucguccucggcgccgucgcugccgacccggaggauuuccgccgccgccaccccuuccggauacggcaguucgcucugc

SEQ ID NO: 58414 - RNA, 63 nt, Pseudomonas aeruginosa PA01
guaccggccucggcgcgcugugcgacguccugcuggaaggcgagcagcucgccgagcugucgc

SEQ ID NO: 58415 - RNA, 82 nt, Pseudomonas aeruginosa PA01
guaccuggcggagggcgaguuccugguggaugucggcuucggcucggccaauccgccgcgagcacugccuuugccgggcgac

SEQ ID NO: 58416 - RNA, 84 nt, Pseudomonas aeruginosa PA01
guagggcgaauagccgcucgcggcuauccgccggcugggguuccggugcgcuggcggauagcgcuggggcgcuauucgcccuac

SEQ ID NO: 58417 - RNA, 61 nt, Pseudomonas aeruginosa PA01
guacaucgucgucgcccuggucaugcugguccgcggcuucgccgacgcgaucaugaugcgc

SEQ ID NO: 58418 - RNA, 76 nt, Pseudomonas aeruginosa PA01
guaacgucgcgucagcgccaggaguuguccggcggcgucacgccagccgcucgacgacgggcagacgcaucgccgc

SEQ ID NO: 58419 - RNA, 80 nt, Pseudomonas aeruginosa PA01
guaagcaucgaacugagucucggcaaucauagacagaaucugauuauuacgauuauugaaauucauaagaugcuccuugc

SEQ ID NO: 58420 - RNA, 60 nt, Pseudomonas aeruginosa PA01
uucgacggcgaccgcgcccuggcccggguguccggccaugaccggcgcggacgccgcgaa

SEQ ID NO: 58421 - RNA, 105 nt, Pseudomonas aeruginosa PA01
uuccccaggucagcgggcuggucgccgagcgcggcuggcggauccgcgaacuggacguggagcgcggccggcucgacgagguauuccgcaaccugacccggggga

SEQ ID NO: 58422 - RNA, 69 nt, Pseudomonas aeruginosa PA01
uuccaugacguacuugucgcccaccagccacagcucgauggcgcgcucgaaguaacugaagucguggaa

SEQ ID NO: 58423 - RNA, 78 nt, Pseudomonas aeruginosa PA01
uucgccgacagcgccagcggccggcuccugcgcgaggucuacgacgcgcggguacggcagauggcggcguccggcgag

SEQ ID NO: 58424 - RNA, 60 nt, Pseudomonas aeruginosa PA01
uucgccgaggagaccuggcggguaccgggcuaccgggccugccugcuguuucccggcgag

SEQ ID NO: 58425 - RNA, 64 nt, Pseudomonas aeruginosa PA01
uucgcgcuggaacgacgucuaccugacucuccggggccaguacggcgcgcgcuccagccgcgaa

SEQ ID NO: 58426 - RNA, 66 nt, Pseudomonas aeruginosa PA01
uucggccuccuucagcuuggccaguacuucgucacgcaauucggggguggccauggggaagccgag

SEQ ID NO: 58427 - RNA, 116 nt, Pseudomonas aeruginosa PA01
uucuucagcggcaggccgcuccagucgcggacuaccugggugccgagccgggcgaaccaguccucgauuucccggcucugcucggcgugggccgcgagcggccgcgagcuggagaa

SEQ ID NO: 58428 - RNA, 94 nt, Pseudomonas aeruginosa PA01
uucgucgccaggaguugggcugagcuucaggcuuccgccuggugccgguacgcgccgggggugaggccgguccacuucuugaacgcgcgaugga

SEQ ID NO: 58429 - RNA, 60 nt, Pseudomonas aeruginosa PA01
uucgucggcgaacuccgagcgcagcaggucggucucguugcgccccugguucucgaugaa

SEQ ID NO: 58430 - RNA, 76 nt, Pseudomonas aeruginosa PA01
uucucgacugcuucuucgauaccgccgaccauguagaacgccugcuccggcaggugaucguagucgccguugagaa

SEQ ID NO: 58431 - RNA, 83 nt, Pseudomonas aeruginosa PA01
uucugguauucgccgucgaugaccucguccaugcgcugcugcagcaggccggcgguguccuuggcgaacagcgggucccagaa

SEQ ID NO: 58432 - RNA, 61 nt, Pseudomonas aeruginosa PA01
uucugcgcgugcagcaccggcacgucgaccacuuccuugaugccggccgccaggugcagga

SEQ ID NO: 58433 - RNA, 110 nt, Pseudomonas aeruginosa PA01
uucagcgcgaucugccgcaccgugacgaucucccugggcagccccuugaguugcuggcggguggauuccagggcgcugucggaggaggcgaucaggcggaucgaguugaa

SEQ ID NO: 58434 - RNA, 80 nt, Pseudomonas aeruginosa PA01
uucagcuuggcgaggaugcgcugcggcuucucguccgaccagucgcugagcagcaccacguagucgcggucguagcugaa

SEQ ID NO: 58435 - RNA, 77 nt, Pseudomonas aeruginosa PA01
uucaaggugccgauauccacgucgacgcucacucccagcaaggguucggcggcggaggcguggguuucgcauucgaa

SEQ ID NO: 58436 - RNA, 130 nt, Pseudomonas aeruginosa PA01
uggggaaugcgcaggacgaaccuggccgagaccacgaugcgcuccgaguagccgccgaaggucggcaggccgucguggcggucgcggccguuguaggucagggucggguauuccgcgcaauacugcucca

SEQ ID NO: 58437 - RNA, 129 nt, Pseudomonas aeruginosa PA01
uggcgcgccuggaugccgggcaacucgccgaggcgcgcaaggcgcuguucguggucagcaccuucggcgacggugaggcgccggacagcgcccgcggcuucgaacgcaaggugcuuggccaggccgcca

SEQ ID NO: 58438 - RNA, 69 nt, Pseudomonas aeruginosa PA01
uggcggcgcuggucauggccuugcucucgucgcugccgaaaccgcgcgaggaacuggccggcggcgccg

SEQ ID NO: 58439 - RNA, 129 nt, Pseudomonas aeruginosa PA01
uggcggugagcggcgcccccucuucgcugacgaacgccggcagccacugcgccugcugcgaggggcugccccagcggcggaugcaguuggccgccgacaacggcaccagcagggccgccgccagcguca

SEQ ID NO: 58440 - RNA, 96 nt, Pseudomonas aeruginosa PA01
uggcgaugccgguguccucgaucacgucgugcagcaucgcggccaucaggcucugaugguccaugugcaugucggcgaggauguuggagaccgcca

SEQ ID NO: 58441 - RNA, 61 nt, Pseudomonas aeruginosa PA01
ugggagcuuuccagugccgggaugaugccuucgaggcggcagcagguguggaaggccucca

SEQ ID NO: 58442 - RNA, 62 nt, Pseudomonas aeruginosa PA01
ugggaaugucggucgccagcugcagggcuuccugggccagcagcucggcgccggccagcucg

SEQ ID NO: 58443 - RNA, 73 nt, Pseudomonas aeruginosa PA01
uggugaccugccuggagggcagcgugcggcucgaacaccucggccagcgccuggaccuccaggccggccagca

SEQ ID NO: 58444 - RNA, 60 nt, Pseudomonas aeruginosa PA01
uggucgacccgccgacgccguucagcaccaguucgugccaaaccucgucggcggggguca

SEQ ID NO: 58445 - RNA, 67 nt, Pseudomonas aeruginosa PA01
ugguggcgggacaaugacacuggccucauuaggcaaugggggcaggucacuugccccgccgaugccg

SEQ ID NO: 58446 - RNA, 58 nt, Pseudomonas aeruginosa PA01
ugguaucgcucggcgccggcggcgcgcccagggugccggcggcgaccuggcgguucug

SEQ ID NO: 58447 - RNA, 128 nt, Pseudomonas aeruginosa PA01
uggguacguccaggucuucgaagucgcugaagaucuuguuggcuucgagguugcccgccaucaguuccucgucgggcagcuggaaguugucaacgaacucggugaugucggcaccaacgaugaacacg

SEQ ID NO: 58448 - RNA, 74 nt, Pseudomonas aeruginosa PA01
ugguucgagcgccccgacccgcugcuccugcaacugcgccagcgcccgcgaccgguggucgggcgcugcagcca

SEQ ID NO: 58449 - RNA, 65 nt, Pseudomonas aeruginosa PA01
uguaugcgguggcgauaccggugauggcguuggucgcgcccgggccggaagucaccagcacgaca

SEQ ID NO: 58450 - RNA, 75 nt, Pseudomonas aeruginosa PA01
uguccggcggcgaacagcagaugcucgccaucggccgcgcgcugaugagcaagccaaagcuguugcuguuggacg

SEQ ID NO: 58451 - RNA, 117 nt, Pseudomonas aeruginosa PA01
uguucgucuugcgcccgucgcugcucgaccauggccugggcggcgccgacuaugucacggcggucggcgagcaacgccaggugcaggugagcggcgagacgcggaucgagaugaaca

SEQ ID NO: 58452 - RNA, 87 nt, Pseudomonas aeruginosa PA01
ugugcgugcgcaggccggcggccuugccgcucugcucgcgcucguagccgaguaccgcgccgagcgccgccgccagcagcaggcgca

SEQ ID NO: 58453 - RNA, 75 nt, Pseudomonas aeruginosa PA01
ugcggucgguuuccgccacuuccugcucaugaggcaccaggcuuucgcggacgaacuggcggaugcuguccagca

SEQ ID NO: 58454 - RNA, 111 nt, Pseudomonas aeruginosa PA01
ugcggagaucgccagccuggugcaggcagugggcgaggaugucggacuggcgcggcagguugugcuggccggcgcuucgacgcuguuguccgccggccugaugucgccgca

SEQ ID NO: 58455 - RNA, 60 nt, Pseudomonas aeruginosa PA01
ugcggauggucaucgaccuggcggacuucgacaacucgcgcuacgcgcuguccacccgca

SEQ ID NO: 58456 - RNA, 74 nt, Pseudomonas aeruginosa PA01
ugcggcaguugcguggguuggaaguggcgcugaccgaggucggcgcggcgaacuucacccaugcccuggcggcg

SEQ ID NO: 58457 - RNA, 66 nt, Pseudomonas aeruginosa PA01
ugcucgccaccggcggcucgaccaaccacacccugcaccugcuggcgaucgcccaggcggcgggca

SEQ ID NO: 58458 - RNA, 63 nt, Pseudomonas aeruginosa PA01
ugcugccuucuucauguccggaguuuuugauaagacuagucccgauguugacagaauguggua

SEQ ID NO: 58459 - RNA, 64 nt, Pseudomonas aeruginosa PA01
ugcuggccuacgccgcggcgcugcugugcgggggggaaaucagcaggcccggcguaguccagca

SEQ ID NO: 58460 - RNA, 68 nt, Pseudomonas aeruginosa PA01
uggccgcgcuggcggaggaggaagucggcgccggcgcgcagguguuccuccaguugccggcgcgaacg

SEQ ID NO: 58461 - RNA, 121 nt, Pseudomonas aeruginosa PA01
uggccgaccugacccggcgcaucgccgagcugcucggccagccugcgccgcagccgaugucgauggccauggcucgcgcgcuggccacccugggccgcuugcgcuaccgggucagcggcca

SEQ ID NO: 58462 - RNA, 57 nt, Pseudomonas aeruginosa PA01
uggccagcucggcgccggcaugauaggccauggcguagccgucgccggcguuggucg

SEQ ID NO: 58463 - RNA, 115 nt, Pseudomonas aeruginosa PA01
uggcaaggcuucggccgaguggcgggaggcccuggauaccauggacgagcugaucuggagcgucggcccgcaugaugauccgcugucccgccaacaguugcuggagcgugugcca

SEQ ID NO: 58464 - RNA, 71 nt, Pseudomonas aeruginosa PA01
uggagcggacgccggccguugcaauggcuguacgagaacgucgcggucgaccagcgcuggugccuggucca

SEQ ID NO: 58465 - RNA, 70 nt, Pseudomonas aeruginosa PA01
uggauggaggguaagugucgcuaaaggugcugguuguaaguacagagccuuccacgcauauccuucagca

SEQ ID NO: 58466 - RNA, 59 nt, Pseudomonas aeruginosa PA01
ugccggcgaggucggccaugacgcccaugacgaagggcagcuggaccuucuucucggca

SEQ ID NO: 58467 - RNA, 61 nt, Pseudomonas aeruginosa PA01
ugccggcgcaggaaagggaucugcgcgguagugaugcgccccagguccuggccgccgagca

SEQ ID NO: 58468 - RNA, 60 nt, Pseudomonas aeruginosa PA01
ugccggcgcaguucgggcgcaaguccaccgaccugaucugcgucgaggaaggcgucggca

SEQ ID NO: 58469 - RNA, 59 nt, Pseudomonas aeruginosa PA01
ugccgggaguagcgguucaccccggcaaagcugucggccuugguggcggucucccggcg

SEQ ID NO: 58470 - RNA, 85 nt, Pseudomonas aeruginosa PA01
ugccguguuccuccagcacccggccgacgaucugcggcaccgugaggugcuggaagaugcgcugguuggugcgcugggcgaggua

SEQ ID NO: 58471 - RNA, 64 nt, Pseudomonas aeruginosa PA01
ugcccggcgacccgcgcggaggacgucgaacugcacgaccgccugcuccgcgauugccugggcg

SEQ ID NO: 58472 - RNA, 74 nt, Pseudomonas aeruginosa PA01
ugcccuggaucacgcagagccggucgaccgccuggcugacuucggccagggggcgccguucgcggaccagguca

SEQ ID NO: 58473 - RNA, 96 nt, Pseudomonas aeruginosa PA01
ugccgcgcuucacgaccggcuccaccgaacuggaccggguucucggcggcggccugguggacgguucgguggugcugaucggcggcgaucccggca

SEQ ID NO: 58474 - RNA, 71 nt, Pseudomonas aeruginosa PA01
ugccgauggcgacgccgccgaucagguugaugaagagaaucagcaggccggcgauggcgucgccgcggacg

SEQ ID NO: 58475 - RNA, 94 nt, Pseudomonas aeruginosa PA01
ugcgccggcaucaaguacggcccgccguaggccugcgcuccucgaccuggcuugucucaggaagcguggcuggcggucaccgggcgcucgcgca

SEQ ID NO: 58476 - RNA, 62 nt, Pseudomonas aeruginosa PA01
ugccuugcgccggcccuggcuagacuggcgcggcccgguuccgucgcgguuggcggaaggcg

SEQ ID NO: 58477 - RNA, 66 nt, Pseudomonas aeruginosa PA01
ugcgcgcaguuuacccggagaaccccgccauggggcgggcuucuaccggaaaagcggcgccaggca

SEQ ID NO: 58478 - RNA, 72 nt, Pseudomonas aeruginosa PA01
ugcgcggcgcgcaccuggaccgcaacaagcugaacagcuccagcgacuaccagguguucagcgccaaccgca

SEQ ID NO: 58479 - RNA, 66 nt, Pseudomonas aeruginosa PA01
ugcgcagcggcugcgccuggaacggcucgcucuaccucggcuauccccucggccagccgcagcuca

SEQ ID NO: 58480 - RNA, 63 nt, Pseudomonas aeruginosa PA01
ugcgcagcugcgagcugaucuggucgaugacgaacaggcugggguagagauugagguugcgca

SEQ ID NO: 58481 - RNA, 115 nt, Pseudomonas aeruginosa PA01
ugcgcauccugcugccgauguccacgcccaucgugauggucugccugaucuggcaguucacccagaucuggaacgacuuccuguucggcgugguguucgccagcggcgauucgca

SEQ ID NO: 58482 - RNA, 59 nt, Pseudomonas aeruginosa PA01
ugcagcacggccugguugucccaccagacgaugucgcccaccgaccaggcguggcugua

SEQ ID NO: 58483 - RNA, 102 nt, Pseudomonas aeruginosa PA01
ugcaccgcuggagcgacuacgccagcgcguucuuggccugccagcggagauucgcccggccugccuggacgcgcugcgcgccgaccguugccugcggcugca

SEQ ID NO: 58484 - RNA, 124 nt, Pseudomonas aeruginosa PA01
ugcacggccugcgacaggcgucgcuuccagccgccggagcgcuugccguugccgcucaucagcggcgccagggaguggcuccgcgcccgcuggcgcugcgacuccauguagaaggccuugugca

SEQ ID NO: 58485 - RNA, 63 nt, Pseudomonas aeruginosa PA01
ucuugaucagcgaguggccggucuuccacaucaccggacggccgccguagccgcugaucaggg

SEQ ID NO: 58486 - RNA, 73 nt, Pseudomonas aeruginosa PA01
ucuuccugcucguccugguacuccagggccagggugugggaaagguccggggucaggucgcugagcagggaga

SEQ ID NO: 58487 - RNA, 71 nt, Pseudomonas aeruginosa PA01
ucuggcgaccagccugcacgagggcauucaacuggcccacgaugcccugcacaccgggcuggcacgggaga

SEQ ID NO: 58488 - RNA, 98 nt, Pseudomonas aeruginosa PA01
ucucggcggcacggaacuggccgauguuggcgcugagcaggacgaucaggucuuccucggcgaucacccggcgcucggccagggccagcaggccgggg

SEQ ID NO: 58489 - RNA, 60 nt, Pseudomonas aeruginosa PA01
ucucguagguguacucgucgguggcgcgcagcucgcgcggcgugucguacuccuccggga

SEQ ID NO: 58490 - RNA, 59 nt, Pseudomonas aeruginosa PA01
ucucgucgcugcuggcaccgaccaccacccagucgauaucggugaccggacggccgaga

SEQ ID NO: 58491 - RNA, 69 nt, Pseudomonas aeruginosa PA01
ugagcugcggacgcucgaagaccacccgcgccacuacugcgugaucaucccagagcgccugccagcuca

SEQ ID NO: 58492 - RNA, 69 nt, Pseudomonas aeruginosa PA01
ugaucaccgucggccuggccgcugcgcuggcccugggccugggcagccgcgaggucgccgggcagauca

SEQ ID NO: 58493 - RNA, 108 nt, Pseudomonas aeruginosa PA01
ugaucacucguccggugccgaucacgcacuggaauggccggccgcgcucguaggaggagucgaacagcgugccgucuuccagggugcccuuguacuggguggugauca

SEQ ID NO: 58494 - RNA, 69 nt, Pseudomonas aeruginosa PA01
ugaucugcccggcgaccucgcggcugcccaggcccagggccagcgcagcggccaggccgacggugauca

SEQ ID NO: 58495 - RNA, 87 nt, Pseudomonas aeruginosa PA01
ugaucgugccgaugcugaagagcgucgagauccaguugggcaucuucuucgugguccugaccuacuucgucaucgucggcucgagca

SEQ ID NO: 58496 - RNA, 82 nt, Pseudomonas aeruginosa PA01
ucggcugccuuggcgacgaugccuacggcgaccaguuguaccgugcgcuacaggccgagggcaucgacugccagggcgucga

SEQ ID NO: 58497 - RNA, 57 nt, Pseudomonas aeruginosa PA01
ucgggauuuccaccgacaagcugcacgcccgcggcccggucggccuggaaggccuga

SEQ ID NO: 58498 - RNA, 76 nt, Pseudomonas aeruginosa PA01
ucggugccugccucggcgccggcggcuaucguguacugaucgcgcgccaucugccgagcgccgcggcgcccgccga

SEQ ID NO: 58499 - RNA, 69 nt, Pseudomonas aeruginosa PA01
ucggugcgcugguggucgagcagcacccgggcguugucggcguagcugcggaucgccgccagcggcugg

SEQ ID NO: 58500 - RNA, 55 nt, Pseudomonas aeruginosa PA01
ucggcgagcugcuccgcguggcugcugcccuugagcaccaugaugcgcuugccga

SEQ ID NO: 58501 - RNA, 91 nt, Pseudomonas aeruginosa PA01
ucggcgaucccaguggccgcugccgcugcaccccggaacagguccagcgcuaccggggcaagcuguccggaccgcugcucgaucgcaucga

SEQ ID NO: 58502 - RNA, 117 nt, Pseudomonas aeruginosa PA01
ucggccuuguguuccugguauuuuuccgccgacugggccugccggugcaggcguuccaguugccgccccagcucuucgcgcaggucggugaggcgugccagguuuuccuggguccga

SEQ ID NO: 58503 - RNA, 79 nt, Pseudomonas aeruginosa PA01
ucgugaagaacccggaagugaaggucggcgaccuggccaagcaggccggugccgaaaucguuuccuucguucguuacga

SEQ ID NO: 58504 - RNA, 61 nt, Pseudomonas aeruginosa PA01
ucgucggcccgcugcaacugccaggugcccagccagagcaguaccggcagcaggccgagga

SEQ ID NO: 58505 - RNA, 97 nt, Pseudomonas aeruginosa PA01
ucguccucgccgagguacucgccgcucuguaccucgaucaucaccaggucgaugauccccggauugcucaggcgguggcuaugcccggcggggauga

SEQ ID NO: 58506 - RNA, 64 nt, Pseudomonas aeruginosa PA01
ucgucgaagagcccgaacgcuuccggcgcggccgcucguuccggagcgcccgggccuucgucga

SEQ ID NO: 58507 - RNA, 61 nt, Pseudomonas aeruginosa PA01
ucgucgaccaggucggccuuguucagcagcagcagcggcuggaugccggcauguucggcgg

SEQ ID NO: 58508 - RNA, 58 nt, Pseudomonas aeruginosa PA01
ucgucgagggugccgaagccgccggggcagagcaccagggcgucggcuuccuugacga

SEQ ID NO: 58509 - RNA, 64 nt, Pseudomonas aeruginosa PA01
ucgguggcgcccugcaucaggcgcgccucgaggaacaggccgcucugcugcagggccuggccga

SEQ ID NO: 58510 - RNA, 100 nt, Pseudomonas aeruginosa PA01
ucguacccgcgguggccaucggcuggcgucucgccgccgagcauugggcggagggcuucgcccacgaggcggccgaggcggcgcugagcuacgccuucga

SEQ ID NO: 58511 - RNA, 80 nt, Pseudomonas aeruginosa PA01
ucucgacgaaggcuuuccaggcagggccguccuccgguccuagcucgucgaggaauaucugccuggcgcucucguggagg

SEQ ID NO: 58512 - RNA, 77 nt, Pseudomonas aeruginosa PA01
ucuagaucggggguuuuacgugucuguggcggcaucggcugagugcuguuccgggcaaaaauucagccgauucuaga

SEQ ID NO: 58513 - RNA, 56 nt, Pseudomonas aeruginosa PA01
ucuccagcucgcccaguugccgacgcucgccccccggcggcugguagcucaaggga

SEQ ID NO: 58514 - RNA, 69 nt, Pseudomonas aeruginosa PA01
ucggagcugcucggccagccggccggggcgcgcagcauaaccccggccggguuuccuggguaugaacga

SEQ ID NO: 58515 - RNA, 69 nt, Pseudomonas aeruginosa PA01
ucggcaugccggcgaugggcgacuucggaucguucuucgccgccggguugaccacgucguuggcaccga

SEQ ID NO: 58516 - RNA, 75 nt, Pseudomonas aeruginosa PA01
ucggcaccgguuccgagcugcgccagccucugggcaucgcgguggucggcgggcugcuggugagccaggugcuga

SEQ ID NO: 58517 - RNA, 65 nt, Pseudomonas aeruginosa PA01
ucgcuggcguuggccaacuccagcgcaugcgccucgucgcgcgcgcggagcaggccgaccagcgg

SEQ ID NO: 58518 - RNA, 74 nt, Pseudomonas aeruginosa PA01
ucgcguccgcgcugcccgccgggaguuugcuucgagauauugccggccuccccggacaccguggcaaagcgcga

SEQ ID NO: 58519 - RNA, 129 nt, Pseudomonas aeruginosa PA01
ucgcggcugaugcugccgaucuacaacggcuucgccuuccugcggcggaugggccggcugauccgcuaccguuggcccagggucuaggcgccgcaggcgaggccggggucaggcgagcaccgccaccga

SEQ ID NO: 58520 - RNA, 100 nt, Pseudomonas aeruginosa PA01
ucgcgggcgcugcugaucucggcgcucugcgccugcagcgcggcaucgacuucgaugccggccaccggagccggcgcgcggaacagccaggcgcccauga

SEQ ID NO: 58521 - RNA, 55 nt, Pseudomonas aeruginosa PA01
ucgcugaggcugggaaugaacucgcugcccauccgcgaggccaccagcccgguga

SEQ ID NO: 58522 - RNA, 88 nt, Pseudomonas aeruginosa PA01
ucgcgcuucaacgcgcgcagcagccuggccggcaguuuuucgucguugaggaagccgaacagguagcugagcagcagcaugacgccga

SEQ ID NO: 58523 - RNA, 64 nt, Pseudomonas aeruginosa PA01
ucgcgcgcagcgccaaggauggccugggcaaccucgcccgggguaccggccaguugugcggcga

SEQ ID NO: 58524 - RNA, 56 nt, Pseudomonas aeruginosa PA01
ucgcgcgcgcuggugcgacaagggcuucgacgaagccauccgcaaggcgcgcauga

SEQ ID NO: 58525 - RNA, 67 nt, Pseudomonas aeruginosa PA01
ucgaugauguagcccuggccgagguccgggccgacguugccgaccugcgacagggcuaccccgccga

SEQ ID NO: 58526 - RNA, 55 nt, Pseudomonas aeruginosa PA01
ucgaugccgccgaucccccgguuuuccugcauguaggugggcgagcggucgucga

SEQ ID NO: 58527 - RNA, 85 nt, Pseudomonas aeruginosa PA01
ucgaugcugcggcuggccugcgcggccugggccggcuugccgaaggccuggccgugggccggcgaagccugggcgcuggcaccga

SEQ ID NO: 58528 - RNA, 55 nt, Pseudomonas aeruginosa PA01
ucgaggccgcccgcgccggcgaccagggucgcggcuucgccgugguggccgacga

SEQ ID NO: 58529 - RNA, 67 nt, Pseudomonas aeruginosa PA01
ucgaccuggcgcgccugcugccggucgaaagcgaaaccgccaucggcuggcuggugagccugaucga

SEQ ID NO: 58530 - RNA, 73 nt, Pseudomonas aeruginosa PA01
ucgacgacguccggcuuguacugguggugguagcgcggcgcggcgacccauuggccgaccgggcgaccgucga

SEQ ID NO: 58531 - RNA, 79 nt, Pseudomonas aeruginosa PA01
ucgacggugaagagcgccaugcgccaggcggccaaccaguugagccgggagcuggugcguggccugcucggcucguuga

SEQ ID NO: 58532 - RNA, 79 nt, Pseudomonas aeruginosa PA01
ucgacgucuccucgcggcgcaagaucgcgcucuucaccaacgucgaggagcgcgcggugaucgcccuggaagacgucga

SEQ ID NO: 58533 - RNA, 61 nt, Pseudomonas aeruginosa PA01
ucgagccgugcuguccggagcggaucuacgaucuuggcugcggaaccggcaucgccaccga

SEQ ID NO: 58534 - RNA, 113 nt, Pseudomonas aeruginosa PA01
ucgccgcgcagggccgcaaccagcaacggcagcgccuccggcagcuccaggucggccaguucgaucagcgccaggcggcguacgccggggucggcguccuccaggcgcggcga

SEQ ID NO: 58535 - RNA, 61 nt, Pseudomonas aeruginosa PA01
ucgccggcaaagucgagggcuuccugaagguccgcgcgggugccgacgauugagccggcga

SEQ ID NO: 58536 - RNA, 85 nt, Pseudomonas aeruginosa PA01
ucgcccucggccugcgccggccggcuggccagcagcgugguggcgaggcucaggcccaggccgagcgcggcgaccaggcggguga

SEQ ID NO: 58537 - RNA, 64 nt, Pseudomonas aeruginosa PA01
ucgccgcccuuggcguugcgggcgacuuucugcaguugcuucucgcagcugucgaggucggcga

SEQ ID NO: 58538 - RNA, 55 nt, Pseudomonas aeruginosa PA01
ucgccgugcucggcggcgacggcacgcacaaggcaguggccgccgaggucggcga

SEQ ID NO: 58539 - RNA, 77 nt, Pseudomonas aeruginosa PA01
ucgccggggagcugccggcggcggugaagaucgucgaggcgagccggggcgagcugccgcugccggucuugcuggga

SEQ ID NO: 58540 - RNA, 67 nt, Pseudomonas aeruginosa PA01
ucgaugucggcgccgaaguugaugcgggugaaguucaguccguuggcggcgucgguggugagguuga

SEQ ID NO: 58541 - RNA, 81 nt, Pseudomonas aeruginosa PA01
ucgccaccuucguuuccgccggcgacagcaguucggcguugcgccgggcgcuggucugcgcggugcuggcggugguggcga

SEQ ID NO: 58542 - RNA, 84 nt, Pseudomonas aeruginosa PA01
ucgccaggcaggcggcgggcaggccgaacaucaucaccgggaacaucccggccaugaacuggccgcccuucgggucgccggcga

SEQ ID NO: 58543 - RNA, 66 nt, Pseudomonas aeruginosa PA01
ucaucuacaacuucggccaggaccugaucgacgaacacgccaucgaggucagcgccgaacagguga

SEQ ID NO: 58544 - RNA, 61 nt, Pseudomonas aeruginosa PA01
uccaccaucccggcgcacguggcugccaccaacugauucgcgauggcgcgcugcuggugga

SEQ ID NO: 58545 - RNA, 64 nt, Pseudomonas aeruginosa PA01
uccacgcugucgacgacgaagccguagugauccauggucugcaggccguugcuggcagcguggg

SEQ ID NO: 58546 - RNA, 93 nt, Pseudomonas aeruginosa PA01
ucagguuggccacgcuccagccgucgaggaucgcaugguggaagcugaauaccagguccaggccguccucgcggacgaacgcggcgaacagga

SEQ ID NO: 58547 - RNA, 84 nt, Pseudomonas aeruginosa PA01
ucagcacgcgugggcugggcugcaggaagcuguucucguggaccuuguugaugaaguacugcagcaucuucucgcagacgcuga

SEQ ID NO: 58548 - RNA, 87 nt, Pseudomonas aeruginosa PA01
ucagcgccugccgcgccucgucguacuugcgccagcgggucagcggcaccagcaggcgcgaggcgaucugcggguugagugcguuga

SEQ ID NO: 58549 - RNA, 69 nt, Pseudomonas aeruginosa PA01
ucaggagcgagccguggucaucgcgaacagcucacagcggggcuccagccggcgacggcucgcuccuga

SEQ ID NO: 58550 - RNA, 98 nt, Pseudomonas aeruginosa PA01
ucagguacuuguggcuggcgcucggcguggcguugccgggcacgcccuggacccgggcgacgcccggcaggcuaccgccgagcgugcugccgcccuga

SEQ ID NO: 58551 - RNA, 57 nt, Pseudomonas aeruginosa PA01
uccgaggacgggcagaggugguggaugaaaccgcccucgacgccgagguccuugaga

SEQ ID NO: 58552 - RNA, 81 nt, Pseudomonas aeruginosa PA01
uccgccacggccagcggcaacuggcggaggcgguguacaaggccgccuccgccgguuguugccugauggcccaggcgccga

SEQ ID NO: 58553 - RNA, 105 nt, Pseudomonas aeruginosa PA01
uccggcgaucacccgcaguucgccggcccugucgggcaggccgacgcggggaaugucggcauccagcagggucugguagcgcggcggguucaucuugucgcugga

SEQ ID NO: 58554 - RNA, 124 nt, Pseudomonas aeruginosa PA01
uccggcucgccguccagcacgcgggucaggcaggugccgcagaugcccugcucgcaggaggccggcagguccaccccggcuucgcgcagggccgccagcacggucugcccggcggcgacccgga

SEQ ID NO: 58555 - RNA, 93 nt, Pseudomonas aeruginosa PA01
uccgggcaccggaugcccuccucccgccugagggagagggccgggauaucggcagccggcgcaauggggaggaccugcauuccgggcgccgga

SEQ ID NO: 58556 - RNA, 102 nt, Pseudomonas aeruginosa PA01
uccccucagcgccugaucagcacccgucggccuuggugcacgaggcgcaggccaugggucugcgccagcaucgccagggccagcggcaggucgucgacggga

SEQ ID NO: 58557 - RNA, 58 nt, Pseudomonas aeruginosa PA01
uccccugcaggcggaucgcgcugcggcccgcgcgcggcucggauugccggcggacgga

SEQ ID NO: 58558 - RNA, 63 nt, Pseudomonas aeruginosa PA01
ucccgcaccugccacgcagccucggcgcgcuacgcgccgccgaccugggcugcggcaacgggg

SEQ ID NO: 58559 - RNA, 91 nt, Pseudomonas aeruginosa PA01
ucccgccgguuuggcuggucagcggcgaacccgcgcgccugccuucgccguuguucgcggacagcugcgacgagcggagcugguccuggga

SEQ ID NO: 58560 - RNA, 57 nt, Pseudomonas aeruginosa PA01
ucccggcgcgguccaggcgcggcaaacguuucccggccacacaggugcccgccggga

SEQ ID NO: 58561 - RNA, 55 nt, Pseudomonas aeruginosa PA01
uccagcaguucggcggcaacaucaagccugaccaacugccggccgagcuguucga

SEQ ID NO: 58562 - RNA, 65 nt, Pseudomonas aeruginosa PA01
uccagcuacggcggcuggcgcgcccgcgccgacgucggcgaagcgccugggcugccgccacugga

SEQ ID NO: 58563 - RNA, 55 nt, Pseudomonas aeruginosa PA01
uccagguagcgcucgaggaaggccugauagucggcccccgccgcgccggccugga

SEQ ID NO: 58564 - RNA, 71 nt, Pseudomonas aeruginosa PA01
ucgacagccaggcccgucgccgcgccugaggccacuucaguucgccagcagcggcgacggcuggcgcucga

SEQ ID NO: 58565 - RNA, 85 nt, Pseudomonas aeruginosa PA01
ucgacauccggccggucgccggacggaucggcgcggagauucgcggcgugacccuguccggcgaacuggacgccgccaccgucga

SEQ ID NO: 58566 - RNA, 71 nt, Pseudomonas aeruginosa PA01
ucgaaauccgccggucgcucgaagcgcuccgccagcaugcgcggcgcguccaggcgaucgagacggaacga

SEQ ID NO: 58567 - RNA, 61 nt, Pseudomonas aeruginosa PA01
ucgaacgccuggccggcaaccgcugggacggcgaccgcgacagcuggccggaggcgaucga

SEQ ID NO: 58568 - RNA, 82 nt, Pseudomonas aeruginosa PA01
uccuucgccgggucgcccggcucgcugcucggcgccggugcguuguuaccugcgggagccgcaggcgccccauuggcguuga

SEQ ID NO: 58569 - RNA, 58 nt, Pseudomonas aeruginosa PA01
uccucggugcgacggaagcuggcgaaccccagcagccgaucgucgcgcucggccagga

SEQ ID NO: 58570 - RNA, 58 nt, Pseudomonas aeruginosa PA01
uccugcggcgggccgucaugcacccgguacaacgccgggauggcgugcuucugcagga

SEQ ID NO: 58571 - RNA, 58 nt, Pseudomonas aeruginosa PA01
uccugcucggccucgcccgagguguggcgguccaccacccggccgagagcgggcagga

SEQ ID NO: 58572 - RNA, 79 nt, Pseudomonas aeruginosa PA01
uccgcgucgagcggcggccccggcaacagcggcgccgcgccgcugccguugcccgggcugccgccggaguugacccgga

SEQ ID NO: 58573 - RNA, 76 nt, Pseudomonas aeruginosa PA01
uccggccgggaagucuucgucggccucgccgagccgcgcaacagcgcgcucuggccgaugggcaucccgcgccuga

SEQ ID NO: 58574 - RNA, 97 nt, Pseudomonas aeruginosa PA01
uccugcagagcgaugcccagggcgaggccguucgccucguccaggccggcaccggccgacacgccaaccgccaugccuucggggauguugugcagga

SEQ ID NO: 58575 - RNA, 60 nt, Pseudomonas aeruginosa PA01
uagcgggagaacucgcggccgcgcuggagcaggccgaagccuuucggguucuccacgcug

SEQ ID NO: 58576 - RNA, 73 nt, Pseudomonas aeruginosa PA01
uagaaggaaggcagcgaauccccagugaugagcugcaaguucagcuggguuuggcaugcugauacuccuucug

SEQ ID NO: 58577 - RNA, 100 nt, Pseudomonas aeruginosa PA01
ucaccgggcugacacagucuccuucuaucuuggucuacaccagauggcgccgcuggcgucuucgugcaaccgauuggagggagaacgaugagcgcgguga

SEQ ID NO: 58578 - RNA, 81 nt, Pseudomonas aeruginosa PA01
ucaccuccugcuuccugcuguucggcuacuacggcaccaacaacuggaugccguccuaccuggagagcgaguuggggauga

SEQ ID NO: 58579 - RNA, 99 nt, Pseudomonas aeruginosa PA01
ucaccucgaccagcuggccuucgcggcguccgcgccggucauggccggacacccgggccagggcgcggucgccgucgaacaccaggcgcaucugggugg

SEQ ID NO: 58580 - RNA, 123 nt, Pseudomonas aeruginosa PA01
ucaccucgcgggcgcggaugcgcgacggacgucuggagggagucgaggagauccuccacaagggcgaugcggugaccucccugcgcggcgaguucgagcgcaucgucgccgucggcgaaggga

SEQ ID NO: 58581 - RNA, 80 nt, Pseudomonas aeruginosa PA01
ucacaggugcaggccgccggccaucagcgcuaccgcgcgcaggucgcgguaccagcgcucggccggaugcuccuugguga

SEQ ID NO: 58582 - RNA, 70 nt, Pseudomonas aeruginosa PA01
ucaaggcgcaccagcuggcggugauggccggcgugcaggccgccauccgccaccugcuggcgcgcuucga

SEQ ID NO: 58583 - RNA, 130 nt, Pseudomonas aeruginosa PA01
guuucccgcgauuuccaugacaaggcgccggcguuggucgagcuguuccgcaaggucgagauccccuugccgcuguucaacgagcugcucgccgacauggcgcagaaucaucgcgaggucggcgaggugc

SEQ ID NO: 58584 - RNA, 62 nt, Pseudomonas aeruginosa PA01
guuguugcuggccaguuggccggacuugaucgacaacucgccggccuuggccagcggcgcac

SEQ ID NO: 58585 - RNA, 57 nt, Pseudomonas aeruginosa PA01
guuguaggugaccaucgcgcaaucgcccucgcgcagggcgcgcaggccaccuucgac

SEQ ID NO: 58586 - RNA, 85 nt, Pseudomonas aeruginosa PA01
guuggcggugaucagcagguccuucgagcgacccgacugggaaaugcagauggccacgucgcugggcuugagggucaccgccgac

SEQ ID NO: 58587 - RNA, 80 nt, Pseudomonas aeruginosa PA01
guugcgcaccaccgagggcggcgaacaguccugcaagccagggcgucggcugcgucgugacgcccgcggcggugagcagc

SEQ ID NO: 58588 - RNA, 60 nt, Pseudomonas aeruginosa PA01
guugcucggcaugcgcaucaaggucgugagcuucgauacccaugcggaugccguggcggc

SEQ ID NO: 58589 - RNA, 55 nt, Pseudomonas aeruginosa PA01
guugcuugcccuugaucugcuuccacaccuggccgagcagcucgggcggcgcgac

SEQ ID NO: 58590 - RNA, 69 nt, Pseudomonas aeruginosa PA01
uacgagaucgucggcgccaacgaccugguccugaugagcaaccagguacaggugcagaaggucuacgug

SEQ ID NO: 58591 - RNA, 79 nt, Pseudomonas aeruginosa PA01
uaccgccauaucaccguucugcucgaggaggccguuuccgcacuggccccgcgggaggacggcugcuaucuggacggua

SEQ ID NO: 58592 - RNA, 60 nt, Pseudomonas aeruginosa PA01
uaccgcugcgcggcauuuucagggcgcuuuuuucggcgucgccacguugucgcgcaggua

SEQ ID NO: 58593 - RNA, 58 nt, Pseudomonas aeruginosa PA01
gccuuggucgccgcgaucacccggcaguccaccgggaucgacugguucgagccgaggc

SEQ ID NO: 58594 - RNA, 56 nt, Pseudomonas aeruginosa PA01
gcgaagcccagcgccaggcgugccucgucggucucgccggccggcuggguauucgc

SEQ ID NO: 58595 - RNA, 79 nt, Pseudomonas aeruginosa PA01
gcgaagcuugggaucgacguacuccggcugcuccgaggccuuggaguccgggucggccaguuguccuucgaggcucggc

SEQ ID NO: 58596 - RNA, 81 nt, Pseudomonas aeruginosa PA01
gcgaaggacggccgcggguugacggaacgggagcuguucauaggcuuucuggcucuucuucguugaucggcgaguccuggc

SEQ ID NO: 58597 - RNA, 88 nt, Pseudomonas aeruginosa PA01
gccuggcggucgccgcccugguccugcugccguucgccgccguccaggcggaagacacgguggaaccgagcggcuacacgccgauggc

SEQ ID NO: 58598 - RNA, 55 nt, Pseudomonas aeruginosa PA01
gccugggccgcgagccaggacggcgacuccggcacccagggccgcagggccaggc

SEQ ID NO: 58599 - RNA, 55 nt, Pseudomonas aeruginosa PA01
gccugggcgaugcccgcgucgaaacccaucccgacagcuggaucgcgcccagcgc

SEQ ID NO: 58600 - RNA, 77 nt, Pseudomonas aeruginosa PA01
gccuggccggccggcuagucuggcugggauccccgacauggagagcgccaugccacugcccaccgaacucgccaggc

SEQ ID NO: 58601 - RNA, 55 nt, Pseudomonas aeruginosa PA01
gccuggagguccaggcgcuggccgagguguucgagccgcacgcugcccuccaggc

SEQ ID NO: 58602 - RNA, 89 nt, Pseudomonas aeruginosa PA01
gccuggugacccucaccggccugggcggcgagugccuggcccggcggaugcgccugccgcccgggcgggucgaggugaucaaccacggc

SEQ ID NO: 58603 - RNA, 97 nt, Pseudomonas aeruginosa PA01
gccuggugacgauccgcgcaagagcggcgacgggcgccacugcgccuuucucggugcacgccugcccggcucgcgguucagccuggacgucgcccgc

SEQ ID NO: 58604 - RNA, 57 nt, Pseudomonas aeruginosa PA01
gccugucggccuccugggaugccgcgccgaacgcgguggccuacgaggccgaauggc

SEQ ID NO: 58605 - RNA, 88 nt, Pseudomonas aeruginosa PA01
gcgagcugggcgaauucgcuggcggagaagugcggguugcccagcgccaccaggucgauccgcgucucgccggcgcuguccagcucgc

SEQ ID NO: 58606 - RNA, 61 nt, Pseudomonas aeruginosa PA01
gcgaggaaggcggccaggucagcugguacggcaagcccgacccggcggccuuccgcaucgc

SEQ ID NO: 58607 - RNA, 60 nt, Pseudomonas aeruginosa PA01
gcgaggaaguugaggauggcguuggacucccacaggcaacugccguccuccagcuccagc

SEQ ID NO: 58608 - RNA, 67 nt, Pseudomonas aeruginosa PA01
gcgaggcaguucaccuggcgguugcccagcacccuggcguaggcgauggccuugucgacccccucgc

SEQ ID NO: 58609 - RNA, 63 nt, Pseudomonas aeruginosa PA01
gcgaucagcgcgcaggagcccggcaccgggaccacccggauacccagcgccugugccuggcgc

SEQ ID NO: 58610 - RNA, 77 nt, Pseudomonas aeruginosa PA01
gcgagggcgggcgggugcuggaacugaccacccugcguuaccucgacggacagccagugagccugauccgccauugc

SEQ ID NO: 58611 - RNA, 60 nt, Pseudomonas aeruginosa PA01
gcgaguggcgccuggccgcgauccucaccgaccucgccugguugcuccgggccuauucgc

SEQ ID NO: 58612 - RNA, 78 nt, Pseudomonas aeruginosa PA01
gcgaguucggcacgaucaccguggagcggucgcccaucuggaucucgguggcgcgcacguugauccgccggauaucgc

SEQ ID NO: 58613 - RNA, 79 nt, Pseudomonas aeruginosa PA01
gcgacuggaagcgcuggugccgccauccccgcuacuauuucgacgacccggcgaugcgccaccuccaccagcgcuacgc

SEQ ID NO: 58614 - RNA, 81 nt, Pseudomonas aeruginosa PA01
gcgacggggcggcgaggaucugcguggucgccggagccaggcgccggcagaccagcgcaggguccucgucgccgaguucgc

SEQ ID NO: 58615 - RNA, 59 nt, Pseudomonas aeruginosa PA01
gcgacugaguacccguugcggaugaucgaggaacacccgcagcaggcgguacucggcgc

SEQ ID NO: 58616 - RNA, 66 nt, Pseudomonas aeruginosa PA01
gcgaccgcggcgcucggcaucgaccaugccguagaucaggacgaugaagaguucgcugaaggucgc

SEQ ID NO: 58617 - RNA, 61 nt, Pseudomonas aeruginosa PA01
gcgaccgucgucgcugacgcucaggcacagcucgucgcccucgcgcagcagacgcaguugc

SEQ ID NO: 58618 - RNA, 67 nt, Pseudomonas aeruginosa PA01
gcgaccucgacgaugcggcgucggcgcugcaccugccccgcgcccuggucgccgucaucgcgaucgc

SEQ ID NO: 58619 - RNA, 81 nt, Pseudomonas aeruginosa PA01
gcgaccugaagaacuucgacuucaccgucuacgaguggcacaaggacgccacccggaccgaggucaaguaagcaucguugc

SEQ ID NO: 58620 - RNA, 67 nt, Pseudomonas aeruginosa PA01
gcgacgcuggcgagcaacugcucggccggcaucggccugccgagcaggaagccuugcagcgaauugc

SEQ ID NO: 58621 - RNA, 62 nt, Pseudomonas aeruginosa PA01
gcgaaguggcguucggcgaacgcggccuggucggcaccaacccgaaggucgagcgccgccgc

SEQ ID NO: 58622 - RNA, 71 nt, Pseudomonas aeruginosa PA01
gcgaauggggacgcgagagcgagcugggcuacacgcugcagagcggcgccuucaagcgucucaacguccgc

SEQ ID NO: 58623 - RNA, 58 nt, Pseudomonas aeruginosa PA01
gcgccaggccugcucguguuccggggccgccuggcgccagcgcugccaggccuggcgc

SEQ ID NO: 58624 - RNA, 61 nt, Pseudomonas aeruginosa PA01
gcgccaccucgcuguaugccucggccucggccagagacaugaagcucacggcgggcggugc

SEQ ID NO: 58625 - RNA, 57 nt, Pseudomonas aeruginosa PA01
gcgccacggcccccagguacgagcgaugcagcgucucggccgggagcgccuggaugc

SEQ ID NO: 58626 - RNA, 81 nt, Pseudomonas aeruginosa PA01
gcgcauuccggaggcgccggaaugggucgccgggguguucucccaucgcggcguccuggucccggugcucgaccucugcgc

SEQ ID NO: 58627 - RNA, 68 nt, Pseudomonas aeruginosa PA01
gcgcaucgaccugguccuugagacuggccugcuccuucaggcgccgguucuccagcaccaggcggcgc

SEQ ID NO: 58628 - RNA, 116 nt, Pseudomonas aeruginosa PA01
gcgcauguacugcuggcuggcaucgacccacggcugguggucccagcuggccagccguccucgcgccagcgcggcggccaccaggcgucggcggcgcuggcugucgaguacggcgc

SEQ ID NO: 58629 - RNA, 92 nt, Pseudomonas aeruginosa PA01
gcgccgccagacccggggcugaaugacaccgucugcaugggcgcgcagcacagccugcgcgcguagccgguauuccuccggguuggcggugu

SEQ ID NO: 58630 - RNA, 62 nt, Pseudomonas aeruginosa PA01
gcgccgccggccaguucaccggcgcgcagagcaguugcgcgccggacagcgccggcaggcgc

SEQ ID NO: 58631 - RNA, 81 nt, Pseudomonas aeruginosa PA01
gcgccgccggccuggagccggccuggcuguucaacaucgccaccgccgugacccugcuggccggcuccgcgcugguccugc

SEQ ID NO: 58632 - RNA, 62 nt, Pseudomonas aeruginosa PA01
gcgccccucuugcccaucgagguaucgcccuugcucgccuuggacagcgagaggaagggcac

SEQ ID NO: 58633 - RNA, 82 nt, Pseudomonas aeruginosa PA01
gcgcccggggcgucggcugcaucgcacgaccggcgcggaccagcagcgggucgucgagcagcucgcgcaggcgguucagcgc

SEQ ID NO: 58634 - RNA, 55 nt, Pseudomonas aeruginosa PA01
gcgcccugcucgaccaggcgcuugaguucgcggucgagcuggcgcagcagggugc

SEQ ID NO: 58635 - RNA, 80 nt, Pseudomonas aeruginosa PA01
gcgaugcugcaggguaauuuccaccugccccggcgcguacuccgaaaucgccgugcgcgccggcaggcccugggccucgc

SEQ ID NO: 58636 - RNA, 89 nt, Pseudomonas aeruginosa PA01
gcgaugguucauucuuuuucgccggcggcccgccuguccgcacgacggaaccgccgggcgccggcgucagucgggaggaaugccguugc

SEQ ID NO: 58637 - RNA, 97 nt, Pseudomonas aeruginosa PA01
gcgcagcagcgaaccgggcuccagcgccagcaggcguugcaggcguaccagcacgcgccgcauggcgccgaggucggcgcgguuggcggagaggcgc

SEQ ID NO: 58638 - RNA, 62 nt, Pseudomonas aeruginosa PA01
gcgcaggaggaucucgucauggcacucgccgccggcgcacagggccggauccuugcucucgc

SEQ ID NO: 58639 - RNA, 130 nt, Pseudomonas aeruginosa PA01
gcgcaggccgggcagaaccccaagcuuuccgagcuguucuucgaggccgggccgaagcaggugaucgacgagauggaacgccuccucgagcaggcccgccgcagcggcaagcuggcguucccggacgcgc

SEQ ID NO: 58640 - RNA, 70 nt, Pseudomonas aeruginosa PA01
gcgcagggccuggaccggauccucgcgcucgaagucgaucacuucggcgccuugcuggcgggccaugugc

SEQ ID NO: 58641 - RNA, 130 nt, Pseudomonas aeruginosa PA01
gcgcagggcuuccuuggggucgucgagcacacugggaucggccagcuugcgguucuccagcaucucgagcacgccguagggggugaugcuguccaggcuuugcagcggucgccgggggaugccgcugcgc

SEQ ID NO: 58642 - RNA, 77 nt, Pseudomonas aeruginosa PA01
gcgccgccugucggcgcaggcuugccgccuuggccgcgagguccggccaggcgggcuugccggcgaaacgcucgcgc

SEQ ID NO: 58643 - RNA, 57 nt, Pseudomonas aeruginosa PA01
gcgccgcgcgcagcaguggcuggcguucggcgaacgccugcaacugccgugcggcgu

SEQ ID NO: 58644 - RNA, 64 nt, Pseudomonas aeruginosa PA01
gcgcgacagugguagcggcgaccugcgcgacgcccuggugcgccugcugcccucgcugucgcgc

SEQ ID NO: 58645 - RNA, 82 nt, Pseudomonas aeruginosa PA01
gcgcgaccuggugaucgccggccugcugaccuuccucgauccaccgaaggaaaccgccggcccggccaucgccgcguugcgc

SEQ ID NO: 58646 - RNA, 56 nt, Pseudomonas aeruginosa PA01
gcgcgacgcuguugcuggcgggcguggcgaucuucggcagcggcaaggcgucgcgc

SEQ ID NO: 58647 - RNA, 74 nt, Pseudomonas aeruginosa PA01
gcgccugaacaucucccggacgaugucggcacugaugccgucgaugccgucgucgcgggcgaaguucuugucgu

SEQ ID NO: 58648 - RNA, 60 nt, Pseudomonas aeruginosa PA01
gcgccggcuuccucgaacugcucggcgccgaggugccgaccagcgccagcgagccagcgc

SEQ ID NO: 58649 - RNA, 61 nt, Pseudomonas aeruginosa PA01
gcgcgagcgcggcugcuccauccagguaugcccgccgaggaugcugucgacccgcucgcgc

SEQ ID NO: 58650 - RNA, 67 nt, Pseudomonas aeruginosa PA01
gcgcgcaccuggcgccguuccuccccggccacgcucgcggcgagcgcaaggaaggcgcggugagcgc

SEQ ID NO: 58651 - RNA, 58 nt, Pseudomonas aeruginosa PA01
gcgcgcagcgagacgguggugcgcuacgccgggcuuggcgccggcgucuacugcaugc

SEQ ID NO: 58652 - RNA, 97 nt, Pseudomonas aeruginosa PA01
gcgcgcgcaggcaggcgagcaucaggugggcgaaguccuggcagaccccgcgacggcgcuccagcacuucguccagcggcgucgccaccuggguggc

SEQ ID NO: 58653 - RNA, 56 nt, Pseudomonas aeruginosa PA01
gcgccugucgucgcgccgcugagauuucccagcggacccgcgcgcacgacaggcgc

SEQ ID NO: 58654 - RNA, 66 nt, Pseudomonas aeruginosa PA01
gcgcggcagcgagcgccaggaggauaccgaacagguaguccccgcgcggggcgccgcugucgccgu

SEQ ID NO: 58655 - RNA, 68 nt, Pseudomonas aeruginosa PA01
gcgcggccgaaggccagguucuucgccggaaccucaugggugaugguggagccggccgcggucgucgc

SEQ ID NO: 58656 - RNA, 73 nt, Pseudomonas aeruginosa PA01
gcgcggccggcugaagcggcgucagauguuguacgccgagggcggcgacggcaggcgcuccagcaagucgugc

SEQ ID NO: 58657 - RNA, 58 nt, Pseudomonas aeruginosa PA01
gcgcggcgccugccccggaagcccuguacggcuggccgggucgcggcgccacuggcgc

SEQ ID NO: 58658 - RNA, 59 nt, Pseudomonas aeruginosa PA01
gcgcggcggaguguuccgccacgccaaucugcuggugccggccaaggacccgcgcgcgc

SEQ ID NO: 58659 - RNA, 68 nt, Pseudomonas aeruginosa PA01
gcgcggcucuggcuaagcucgaccuucaaacaacgaaaggacgccagcaugguccagagcgccccagc

SEQ ID NO: 58660 - RNA, 101 nt, Pseudomonas aeruginosa PA01
gcgcgggggcgacgaucagacccagcuccggggucucugccugcgggucgaggcggaggaagccaccggacucgacgguguucgaggucagcgccccgcgc

SEQ ID NO: 58661 - RNA, 55 nt, Pseudomonas aeruginosa PA01
gcgcgucgcccugggugacgcguccggaggucaggcugaucacccaggcgugcgc

SEQ ID NO: 58662 - RNA, 69 nt, Pseudomonas aeruginosa PA01
gcgcguccauggcggcgucgagaaagcgauccaccauuacccacgcgaacacuacgccgccuggaucgc

SEQ ID NO: 58663 - RNA, 117 nt, Pseudomonas aeruginosa PA01
gcgcggucaucgcggcugccgacggcgaacugccagguccgugacucguggccguccuccggcuggccggggcgcucgaccuggagguccggcggcggguugcgguugaucgcacgc

SEQ ID NO: 58664 - RNA, 60 nt, Pseudomonas aeruginosa PA01
gcgcgguggucuucaggccggcgacgucggagccggcgccgaccucggagacgccgaugc

SEQ ID NO: 58665 - RNA, 78 nt, Pseudomonas aeruginosa PA01
gcgcuucaugccgaugcugaugaccgccgccggcaccgugaaggccgcccgcgugcugauccucggcgccggcgucgc

SEQ ID NO: 58666 - RNA, 70 nt, Pseudomonas aeruginosa PA01
gcgcuucuacaagcgacgccggcucagcccggacaccgucggggaaaagcuggugcgcgccguggagcgc

SEQ ID NO: 58667 - RNA, 76 nt, Pseudomonas aeruginosa PA01
gcgcuugccggccugacugucugccgggcaacagcgggacaacagggcuguccggcagaagacaggccgguuccgc

SEQ ID NO: 58668 - RNA, 121 nt, Pseudomonas aeruginosa PA01
gcgcuugguacgcauggccuugagggucgccggcgagcaguuggcgauguccaccugcgaaccuucgugcucgaucagcagcuugccgcggcugaccuuguucaggccguugaugcagcgc

SEQ ID NO: 58669 - RNA, 63 nt, Pseudomonas aeruginosa PA01
gcggaaauggccaagggagccgggccuacgaucguaggcgagccuccccgggccauuuccugc

SEQ ID NO: 58670 - RNA, 63 nt, Pseudomonas aeruginosa PA01
gcggaagcgcugcgggucguccgugcccugcaccucaaaggcacggauuuccagcgcauccgc

SEQ ID NO: 58671 - RNA, 56 nt, Pseudomonas aeruginosa PA01
gcggaauggcugucgccccaacugaccagcagcggucguucggcagccaguuccgc

SEQ ID NO: 58672 - RNA, 58 nt, Pseudomonas aeruginosa PA01
gcggacgccuggcccguccuggcggacgugaaugccgcggaugggguggggcguccgc

SEQ ID NO: 58673 - RNA, 96 nt, Pseudomonas aeruginosa PA01
gcgcggaccuggccggcguggcgaccuucaagcgucggcucaaggccgcccaggccgagcuggagcgugaguucgccgcgugcugggacgaugcgc

SEQ ID NO: 58674 - RNA, 71 nt, Pseudomonas aeruginosa PA01
gcgcggagaggccgucggcgaccacgauggccaggucgaucugcccgucguagccggcggcguguucgcgc

SEQ ID NO: 58675 - RNA, 77 nt, Pseudomonas aeruginosa PA01
gcgcgggucgaggcgccacucggcagccugccgcugucugcgccgagcagcggggugcugguggcccuggaaguggc

SEQ ID NO: 58676 - RNA, 56 nt, Pseudomonas aeruginosa PA01
gcgcgugcauuggcuggccggcgaccagaagcugcuggcccaggacuaugccgcgc

SEQ ID NO: 58677 - RNA, 75 nt, Pseudomonas aeruginosa PA01
gcgcguuccuccugcugguggugcuuuaccuggcgcuguggcgcccggccgagcgccaucugcagucggcgcggc

SEQ ID NO: 58678 - RNA, 76 nt, Pseudomonas aeruginosa PA01
gcgcucgacccgcaggccgaccaguucgcugaugucgaagaaacggcgccaguugaugucguccgccgcggugcgc

SEQ ID NO: 58679 - RNA, 106 nt, Pseudomonas aeruginosa PA01
gcgcucggcgaugauccagccgaugcguacgccgggcgagauggucuuggagaaacucgagcaguagaucacccggccgucgcggucgugggacuugagcgagcgc

SEQ ID NO: 58680 - RNA, 74 nt, Pseudomonas aeruginosa PA01
gcgcucgggauugcggcggguaagcgcaagcgguuauucggccaaccucccgcgacuauccgccgugccggcgc

SEQ ID NO: 58681 - RNA, 58 nt, Pseudomonas aeruginosa PA01
gcgcucucgcuggucuuucaggcguucuccggaugccgucucagccagcgcagggcgu

SEQ ID NO: 58682 - RNA, 67 nt, Pseudomonas aeruginosa PA01
gcgcugcaucaaccugcuggagaacccgcaccagggccagauccuggucuccggcgaagagcugcgc

SEQ ID NO: 58683 - RNA, 78 nt, Pseudomonas aeruginosa PA01
gcgcugcuccaucgcggucaccccgcccugcuccuucagccauucgaagaccaggccggacagguaccaggaguaagu

SEQ ID NO: 58684 - RNA, 96 nt, Pseudomonas aeruginosa PA01
gcgcuggucgucagcaaccauggcggacgccaacuggacggcgcgcccucgaccaucagcgcgcugccggcgaucgucgaggcggugggcgagcgc

SEQ ID NO: 58685 - RNA, 59 nt, Pseudomonas aeruginosa PA01
gcggcggccguucauguaccagaugguguucuucaacucguguaccgaagggucgcugu

SEQ ID NO: 58686 - RNA, 57 nt, Pseudomonas aeruginosa PA01
gcggcggcgucucgugggccugguaaugaccggccagcgcccucggccggccgucgc

SEQ ID NO: 58687 - RNA, 63 nt, Pseudomonas aeruginosa PA01
gcggcggcuugcuggcgaucccggcgcuaggggugaucuucggucucgaccagcaacuggcgc

SEQ ID NO: 58688 - RNA, 107 nt, Pseudomonas aeruginosa PA01
gcggcucgagagcgguccgcugguggcgcgccuggaccgucggcgccccgaucucuaccugcugccgcuggaccaggggcgccccaccggcgaccuguucacccugc

SEQ ID NO: 58689 - RNA, 59 nt, Pseudomonas aeruginosa PA01
gcggcugguugaucucgugggcgaugcccgaggccaguucgccgagagugaccagccgc

SEQ ID NO: 58690 - RNA, 67 nt, Pseudomonas aeruginosa PA01
gcggcguguccuccgguggggcgguggcggcgaugcugcgccugucccgcgaacuggagaaugccgu

SEQ ID NO: 58691 - RNA, 59 nt, Pseudomonas aeruginosa PA01
gcggcgccgcccugcugcuggcggccaagguggcacgccagagcccgguggcgauccgc

SEQ ID NO: 58692 - RNA, 56 nt, Pseudomonas aeruginosa PA01
gcggcgcgaccagggcgaucuggccgucgcggaugcccagcgcguggucgcgcagc

SEQ ID NO: 58693 - RNA, 83 nt, Pseudomonas aeruginosa PA01
gcggcgcaucagcaccaggcugggcuccauggcgucgagguucaucucgacccggcuuuccgccucggugcgaaugccgccgu

SEQ ID NO: 58694 - RNA, 93 nt, Pseudomonas aeruginosa PA01
gcggcgagcgagcuguucgagcgcucgguccuguugcuggcccaggaguucuucuacaccgaguacgacuggcgcaucggcgugcucgaccgc

SEQ ID NO: 58695 - RNA, 58 nt, Pseudomonas aeruginosa PA01
gcggcgauagcggccuugaucucgucgcgcuuggcggcgaucggcaggcugucgucgu

SEQ ID NO: 58696 - RNA, 77 nt, Pseudomonas aeruginosa PA01
gcggccuguucgauggcgugguggaccaccgggauaccgugggugaggaugccgccgccgaccaugaacaucgccgc

SEQ ID NO: 58697 - RNA, 78 nt, Pseudomonas aeruginosa PA01
gcggcgaaccggagccguccgguaccacgucuuccggcagcaccaccggcaacuggucggccggcaccgggacgucgc

SEQ ID NO: 58698 - RNA, 79 nt, Pseudomonas aeruginosa PA01
gcggccggccaggucggcuucaccucggugccggcgacggucgccagccugaccagccuggccaccuuccugaugccgc

SEQ ID NO: 58699 - RNA, 90 nt, Pseudomonas aeruginosa PA01
gcggccagcgccgggaucagcucaggcgaugccugcuugcugcgcacguagucggagaguaccuggcgcggaucggccggcgccgguugc

SEQ ID NO: 58700 - RNA, 62 nt, Pseudomonas aeruginosa PA01
gcggaugguccgggugcggucguugagcacgucuaccucgauggucgccgggagcaucucgc

SEQ ID NO: 58701 - RNA, 66 nt, Pseudomonas aeruginosa PA01
gcggaucugacggcgcgucccugcccgccccauccacgggagcgggcagggccuugucagccccgc

SEQ ID NO: 58702 - RNA, 61 nt, Pseudomonas aeruginosa PA01
gcggcagaucggcgagcgcggcgaccuggacaaggucagcuucggccuggucgguuuccgc

SEQ ID NO: 58703 - RNA, 80 nt, Pseudomonas aeruginosa PA01
gcggcagcggcaggcuggcguugcccuugccggugaagccgauguucaucgggaaggcgucggcggccuggagcauccgc

SEQ ID NO: 58704 - RNA, 57 nt, Pseudomonas aeruginosa PA01
gcgggcgguucuucgucgcccccaugggggaggucggcgaaguccugcacgaaccgc

SEQ ID NO: 58705 - RNA, 58 nt, Pseudomonas aeruginosa PA01
gcgggcgccguggaucagccgcgagagcaggucgcggcccaguucgucggugccgagc

SEQ ID NO: 58706 - RNA, 62 nt, Pseudomonas aeruginosa PA01
gcgggcaggcucauggcagcucggcgaaguagcagcguugcgcagccuugagcauguagcgc

SEQ ID NO: 58707 - RNA, 83 nt, Pseudomonas aeruginosa PA01
gcgggccaggcgcacgccgucggcgucguuuuccgccagguauuccgcggugccggcgaccugcgcgugcaguucggcuccgc

SEQ ID NO: 58708 - RNA, 64 nt, Pseudomonas aeruginosa PA01
gcggcuugccgguuuccucgccgaucacucgggccagcucgucggcgcgggacuugagggucgc

SEQ ID NO: 58709 - RNA, 62 nt, Pseudomonas aeruginosa PA01
gcgggaagucgagggucuuggaguaggcggagaagccggcgacgaucaucuucggcuuaugc

SEQ ID NO: 58710 - RNA, 95 nt, Pseudomonas aeruginosa PA01
gcgggaugaaccagcgcgccagcaggcugccggguacgccgaggacgaacggggccucggcggucugccggcgcagcucggcacagacgccacgc

SEQ ID NO: 58711 - RNA, 75 nt, Pseudomonas aeruginosa PA01
gcgggggcgaagcgcgcgagaaagcggucgguggccgagggcgcgguaccggcgaguuccgcgcguuccuugcgc

SEQ ID NO: 58712 - RNA, 68 nt, Pseudomonas aeruginosa PA01
gcggggucggcagggccacccagaagguacccuugcggucgcccuggagguuguccggcaagcccggc

SEQ ID NO: 58713 - RNA, 74 nt, Pseudomonas aeruginosa PA01
gcgggucuucuccgucgagcggauccaggcguugcaggacaaggccaaggagcgucuugcggagcuaaaccugc

SEQ ID NO: 58714 - RNA, 68 nt, Pseudomonas aeruginosa PA01
gcgggugaagaccggcacgucggcgcccaggcgcaggcccagggcggcgaugcgguccucgucccagc

SEQ ID NO: 58715 - RNA, 55 nt, Pseudomonas aeruginosa PA01
gcggugacgaucuccuugauuccggugucgcgggucaggccgaagaucgcgccgc

SEQ ID NO: 58716 - RNA, 77 nt, Pseudomonas aeruginosa PA01
gcgguggagucgaugccgcugggugccgcuucgguguucgccgccgagggccugauggcgacgcuguauuccaucgc

SEQ ID NO: 58717 - RNA, 64 nt, Pseudomonas aeruginosa PA01
gcggugaugcccuugcgcgccagccacugccgcaccacccgcugcgcggccugggcgucgucgc

SEQ ID NO: 58718 - RNA, 126 nt, Pseudomonas aeruginosa PA01
gcggugccgaucacguucaggccggucaguugccgggccaguuggaccaggaucgaaccgaccccgccggcggcaccgaccaccagcaggcucuggcccuggucggccuugccuucggcgaucugc

SEQ ID NO: 58719 - RNA, 126 nt, Pseudomonas aeruginosa PA01
gcgucacguaacgcgacgcugguaugggugaaugccgccggauugaugaugaugaaguccacgccuucgucgcgcgcggcauggauccggucgaucaguucguauucggcguugcucugcagaugc

SEQ ID NO: 58720 - RNA, 58 nt, Pseudomonas aeruginosa PA01
gcgucccggcgagcgcgccgagcgggccggcuggcgcgccgaccagucgcgaggacgc

SEQ ID NO: 58721 - RNA, 76 nt, Pseudomonas aeruginosa PA01
gcgucgaccugcuccacggcggcauagagcggauccagggccgcgcccuggggcgccugcugcuacaggucggcgc

SEQ ID NO: 58722 - RNA, 58 nt, Pseudomonas aeruginosa PA01
gcgucgaugauggcgucggacagcggcgugucgaugcugccggcggcgucguugucgu

SEQ ID NO: 58723 - RNA, 76 nt, Pseudomonas aeruginosa PA01
gcgucgccgccgggcgcccggacgugcagcgcgggcugcugcgcuggauguuccuggugcucgaggucggccacgc

SEQ ID NO: 58724 - RNA, 58 nt, Pseudomonas aeruginosa PA01
gcgucggccaggaggugguacgccagacccuggagcggaucgagcgacuggccgaggc

SEQ ID NO: 58725 - RNA, 130 nt, Pseudomonas aeruginosa PA01
gcgucuucagcgagccgcgucggcuggucucgccggucaccgacgagcgccucgacuacaccgcgcgcaucgaccugcguggccugccagccgaccagucgaucuucuaccgggugcgcuucgaggaugc

SEQ ID NO: 58726 - RNA, 75 nt, Pseudomonas aeruginosa PA01
gcgugcgugguggccgggcagaugcuggucucggcgcucugcgaccaguucggcugggccgguuucccggugcgc

SEQ ID NO: 58727 - RNA, 83 nt, Pseudomonas aeruginosa PA01
gcguggaguacgccgcgguaccgcgccuggccagugccgaauauuaccuggagcagggcugcgugccuggcggcacccugcgc

SEQ ID NO: 58728 - RNA, 74 nt, Pseudomonas aeruginosa PA01
gcgugggaucuucuucgccagcguggcgccggcgcugcuggugcuggcccuggcgaugcgcuggcugcccaggc

SEQ ID NO: 58729 - RNA, 89 nt, Pseudomonas aeruginosa PA01
gcuggcggccaacugggugauggucgagcugggcagccugcucaacaaggacggccuggagaucgagcaguccccgguguccgccgagc

SEQ ID NO: 58730 - RNA, 76 nt, Pseudomonas aeruginosa PA01
gcuggcccgcgaacauggacuggaaccggcgcagauggcacuggccuacgucacuucgcggccguucgugaccagc

SEQ ID NO: 58731 - RNA, 56 nt, Pseudomonas aeruginosa PA01
gcuggccagcguguuccccgaccagguggcgugccuggagaauaucgucggcgagc

SEQ ID NO: 58732 - RNA, 62 nt, Pseudomonas aeruginosa PA01
gcuggccgcgcuggccgaggcagggcucaagggcgaccgccaggccuaugccgcguaccagc

SEQ ID NO: 58733 - RNA, 55 nt, Pseudomonas aeruginosa PA01
gcuggccgggguggcggugccgagggcgccguggaagcucgccacgccggccagc

SEQ ID NO: 58734 - RNA, 72 nt, Pseudomonas aeruginosa PA01
gcuggcgcuggcugcgaucggcuggcuggcgucgaguugcagaugcuggcgcuggucgcugccgacgagggc

SEQ ID NO: 58735 - RNA, 62 nt, Pseudomonas aeruginosa PA01
gcugggagaacucguagacgcugcccggcaccucaagggccgcggccugcaauucuuccagc

SEQ ID NO: 58736 - RNA, 85 nt, Pseudomonas aeruginosa PA01
gcuggucaguuucgagaugccuucgguguaggccuugucgaacugcagcggaaugccgaaggcgaucgaggcgaggauggucagc

SEQ ID NO: 58737 - RNA, 88 nt, Pseudomonas aeruginosa PA01
gcuggugguguccggugggcgcaguccgguggccuuccucgaagccuugagcgaggagccgcuggacuggucgcggaucacagucagc

SEQ ID NO: 58738 - RNA, 70 nt, Pseudomonas aeruginosa PA01
gcuggugcccaguuccgccgccgcgcgcgccagguugccggugcgcaugaaggcgaggaagguuuccagc

SEQ ID NO: 58739 - RNA, 67 nt, Pseudomonas aeruginosa PA01
gcuggguuccgccgccggcguccaggccgccgacaacuucgucggccugaccuggggcgagaccagc

SEQ ID NO: 58740 - RNA, 84 nt, Pseudomonas aeruginosa PA01
gcugcugcgcgugcugcaggaacgcgagguggugcggcucgguucgcgccggccgauccccaucgacgugcggcugguggcggc

SEQ ID NO: 58741 - RNA, 77 nt, Pseudomonas aeruginosa PA01
gcugcuggcggaacaccaggauguggugcucgcgcagcgccugcuugagcgccaggaccugcuccggcgccagcggc

SEQ ID NO: 58742 - RNA, 68 nt, Pseudomonas aeruginosa PA01
gcugcuggcgguauucggccaccagcggcaccaguugccggccaaggcugacguacagcgccagcagc

SEQ ID NO: 58743 - RNA, 86 nt, Pseudomonas aeruginosa PA01
gcugcucgcgccgcgccucgaccucgcgcugcacgucgcgauacggcgugaccgcggagcccggucgggcgcugcgcuccagcggc

SEQ ID NO: 58744 - RNA, 64 nt, Pseudomonas aeruginosa PA01
gcuggaacuggaggacauccagguccucgaacagggcgacggccuggucuacuucagccgcagc

SEQ ID NO: 58745 - RNA, 128 nt, Pseudomonas aeruginosa PA01
gcuggaucgcgcugguguugaggcugaucuggaucgccgcgguguccgggcugaguuccaccagguauuucuggaucgccggccccggcgccauguugaacacgcaccagaacaccaccgcgcccagc

SEQ ID NO: 58746 - RNA, 65 nt, Pseudomonas aeruginosa PA01
gcuggagcgggccuuagcccaggugcuucuuguccagcucgaucgccuggucgaggguuuccagc

SEQ ID NO: 58747 - RNA, 71 nt, Pseudomonas aeruginosa PA01
gcuggaggcgcgcaucgcucgacuggagcgacagauucaggcucacguacguggcgaugcccgcauccagc

SEQ ID NO: 58748 - RNA, 72 nt, Pseudomonas aeruginosa PA01
gcugcacagcgagcgggaguugcucgcccgcggccaggagcugggcgaggaggguuuccgcgugcugguggc

SEQ ID NO: 58749 - RNA, 103 nt, Pseudomonas aeruginosa PA01
gcugaugaccgcccugguggcgucccucgguuucgugccgauggcccuggccaccggcaccggcgccgaggugcagcggccgcuggcgacgguggugaucggc

SEQ ID NO: 58750 - RNA, 61 nt, Pseudomonas aeruginosa PA01
gcugccgcugcuggccaguucggagcgcgucacucugcgcuucgggcugucgguguugcgc

SEQ ID NO: 58751 - RNA, 66 nt, Pseudomonas aeruginosa PA01
gcugccggugcucuaucgcuggacccacgggcgcgacgccggaccgcgcgaggagacgccggcggc

SEQ ID NO: 58752 - RNA, 61 nt, Pseudomonas aeruginosa PA01
gcugccgucgcgcggcucccagccggcguuccaguagggcgcccgcucgcucggcggcagc

SEQ ID NO: 58753 - RNA, 91 nt, Pseudomonas aeruginosa PA01
gcugcgcacauagcgggccagcucgcgcagggcauggccgacauccuccaggcucgccuugcccggcuuggcgcuacgaccgcugugcagc

SEQ ID NO: 58754 - RNA, 85 nt, Pseudomonas aeruginosa PA01
gcugcgcgccgcuucgucgaggccggguagcgccucgcuggacagcaccaguucgccgacccggcgcuggcgcucggcacgcagc

SEQ ID NO: 58755 - RNA, 106 nt, Pseudomonas aeruginosa PA01
gcugcgcgcgccaucgagcgccagcgcaccgccaugggccgccagcaggucguccggcacgcgguucuccaggcgauugcgcugguagucgaugccgccgcgcagu

SEQ ID NO: 58756 - RNA, 72 nt, Pseudomonas aeruginosa PA01
gcugcggcgcaggaugggcguggacgcgcuguccggguucgucuucgagaugcucuuccugcugccgcuggc

SEQ ID NO: 58757 - RNA, 59 nt, Pseudomonas aeruginosa PA01
gcugcggcuauugcggcucagcgcggugaccagcgcgccgaaaucgcgacugccgaggc

SEQ ID NO: 58758 - RNA, 55 nt, Pseudomonas aeruginosa PA01
gcuccauuuauccaggggcagauaugaaaauaucugcccuuguucuaaugguagc

SEQ ID NO: 58759 - RNA, 57 nt, Pseudomonas aeruginosa PA01
gcucccguccacgcggcaacggcgcccucggagccguuccagccgccggcggaaagc

SEQ ID NO: 58760 - RNA, 65 nt, Pseudomonas aeruginosa PA01
gcuccggccgccccggcuuccucauccgugccgcccuggcgaccauggggucggggcuguggggc

SEQ ID NO: 58761 - RNA, 62 nt, Pseudomonas aeruginosa PA01
gcuccggccuucugaaggcucuucuugaaucagaaaaaccuuacgccagaaguagugggggc

SEQ ID NO: 58762 - RNA, 76 nt, Pseudomonas aeruginosa PA01
gcuccggggacaggcgccgcuugauguucugcacguugugcaggaucgcgccgagcggguuguugaucucgugggc

SEQ ID NO: 58763 - RNA, 112 nt, Pseudomonas aeruginosa PA01
gcucgccggguugcucaucgcggugcuguucagcuaccgccgcaagcgcgucuacgacuugcagcggaucgagcaggccgaacgcgucgaugucagcuacaacccgaagagc

SEQ ID NO: 58764 - RNA, 100 nt, Pseudomonas aeruginosa PA01
gcucgccuggcgcuaucgaggcuccgagcuggaguugcggauuggcaccgacagugucgacccgcgucucuaugugaggcguuucauggagucggggagu

SEQ ID NO: 58765 - RNA, 60 nt, Pseudomonas aeruginosa PA01
gcucgccuggcugcgcagcgagaugcccggccguccgggaaugcgcggcagccaggcggc

SEQ ID NO: 58766 - RNA, 128 nt, Pseudomonas aeruginosa PA01
gcucgcggcgcuugaucgaggcgauguccucggcggcgggcagcgcauccgacagcgccggguccuuggccgcuuucagcgggucguagccgagcggguccugggcaucgcugaaggugccgcucugc

SEQ ID NO: 58767 - RNA, 68 nt, Pseudomonas aeruginosa PA01
gcucgcugggguccagccagaggccgcggaagaggaacaccgcgacgaucaggaagauccccagcggc

SEQ ID NO: 58768 - RNA, 85 nt, Pseudomonas aeruginosa PA01
gcucggcggucggucggacggcggcaggccggucauggcacugucgccaccgguggccggguugccgcugacgccgaucaccagc

SEQ ID NO: 58769 - RNA, 55 nt, Pseudomonas aeruginosa PA01
gcucgggucgagggccuugagacgcuccagcagggucaggccgucgaugccgggc

SEQ ID NO: 58770 - RNA, 57 nt, Pseudomonas aeruginosa PA01
gcucggguguccugcaagcagaucacgucggcauucugugcuugcagccaacugagc

SEQ ID NO: 58771 - RNA, 103 nt, Pseudomonas aeruginosa PA01
gcugacgauccgccccggcagcacguagcgcccgcgcaacugggaaagcuccuggucgcucaguucggcgggggcgaagaggucgcuggcgggggcgggcagc

SEQ ID NO: 58772 - RNA, 83 nt, Pseudomonas aeruginosa PA01
gcugacugccaagcgccugcgccugucggccggcgccucgguacgcgcggugccgcugucggcgcagaagcgcgguugaaagc

SEQ ID NO: 58773 - RNA, 65 nt, Pseudomonas aeruginosa PA01
gcugagccaggcgcgcaucgccaugaacgacaaggaauacgaccaggccaagcgccuggcgcagc

SEQ ID NO: 58774 - RNA, 64 nt, Pseudomonas aeruginosa PA01
gcugagcgccugcucgcggcugaucaauugggccucgaucacguccggcaggcgcucgaucugc

SEQ ID NO: 58775 - RNA, 103 nt, Pseudomonas aeruginosa PA01
gcucucgaccuccaggcgcagucgcggacgcucuucggugaagcgcgucagcaccggcaucagcacuucgccggcgaggucuuccggcacgccgaggcgcagc

SEQ ID NO: 58776 - RNA, 88 nt, Pseudomonas aeruginosa PA01
gcucuguucgaagucggcgaggaugcgcaggucggcgugcucgcgcagcgggcugucgcugcugcacaucuguccgacuuuccagcgc

SEQ ID NO: 58777 - RNA, 67 nt, Pseudomonas aeruginosa PA01
gcucuugccggccacaugcucggggguaccccgcggguaccgacgguagguggacggcacgcugagc

SEQ ID NO: 58778 - RNA, 113 nt, Pseudomonas aeruginosa PA01
gcucaaguucgaguccggcgcgcaccgcgugcagcgggugccggaaaccgaaucccagggccggauccacacuuccgccugcaccgucgcggugcugccggagccggacgagc

SEQ ID NO: 58779 - RNA, 129 nt, Pseudomonas aeruginosa PA01
gcucaggucgauggccucgccgagguccucgcggccgugcccuucgagcugcaccagcacgcuggcgucgccgcuccagcggcaggucgcgcgggccagggcggucagcagcaggucguugaccugggu

SEQ ID NO: 58780 - RNA, 66 nt, Pseudomonas aeruginosa PA01
gcucagaccacuccggccgccgcacgccaggccugguuauggcucuggguguacugcuggaugagc

SEQ ID NO: 58781 - RNA, 105 nt, Pseudomonas aeruginosa PA01
gcucaugcgcuugccgucgcgcaggaacaguucgacgcccagguccuccucgagcuggcggauccgcguggugacguucgacugcgcucgcugcaaccgcugagc

SEQ ID NO: 58782 - RNA, 73 nt, Pseudomonas aeruginosa PA01
gcucaugugcuggccgauuucgccgagcgccgcgagcugaucgccaagcgcguggccgaacuggccgccgagc

SEQ ID NO: 58783 - RNA, 76 nt, Pseudomonas aeruginosa PA01
gcuacuucagccagauggucggccucacggugcagaacuucgucagcgcggcggucggccucugcgugcugguggc

SEQ ID NO: 58784 - RNA, 67 nt, Pseudomonas aeruginosa PA01
gcguugauggcggccagggccaguggcgugccuaucccggccaggcgcugguugaccgccucgaugu

SEQ ID NO: 58785 - RNA, 56 nt, Pseudomonas aeruginosa PA01
ggacgcgcagugccggcaccgccaccccgccgcucuggaugccggcgcuguagucc

SEQ ID NO: 58786 - RNA, 55 nt, Pseudomonas aeruginosa PA01
ggacaaggccuugcgcaaccgcggcguacaagucgcggugggcugcaucuuuucc

SEQ ID NO: 58787 - RNA, 72 nt, Pseudomonas aeruginosa PA01
ggaagauccagcccggucuugcgccguuucauuucgucgaugcguugucgcagcgccaggcgcugggcuucc

SEQ ID NO: 58788 - RNA, 61 nt, Pseudomonas aeruginosa PA01
ggaaaucuggucgaugaauucgcggaugucggcauccuugagguugaucguccagugcgcc

SEQ ID NO: 58789 - RNA, 130 nt, Pseudomonas aeruginosa PA01
ggaacuggugcaccgggccaucgacagcggcgugcugcggcugggccugccgcugccgcucgccgaggaggcucgcggcagucucggcuaggggcgccgucgcugcuguccggcgcuucacugccagccc

SEQ ID NO: 58790 - RNA, 75 nt, Pseudomonas aeruginosa PA01
ggaacagcgccgcguccagcuccaggcgccguccgaggaacucccacuuggugcccagcucguaggugcuguucu

SEQ ID NO: 58791 - RNA, 85 nt, Pseudomonas aeruginosa PA01
ggagaacaacugcaccaguugcggcuucaacgcguugcgguuggccgccucgacgaagccgcgcagguagucgccguugaucucc

SEQ ID NO: 58792 - RNA, 89 nt, Pseudomonas aeruginosa PA01
ggacacccaccggcaggccgucgacgaagccggcgggcauggacagccccggcaggccggcgagguuggcggugaugguguagaugucu

SEQ ID NO: 58793 - RNA, 61 nt, Pseudomonas aeruginosa PA01
ggacaguugccaaucccgcagcgaggucgcuuccacugcgcugaagggcuccgcgcugucc

SEQ ID NO: 58794 - RNA, 98 nt, Pseudomonas aeruginosa PA01
ggacguuguugaugaacgacuucggaucguucagcaccuugcggucgaccugguaggcccagaacugcuuggagaucucgaaguucucguugaucgcc

SEQ ID NO: 58795 - RNA, 73 nt, Pseudomonas aeruginosa PA01
ggacgucggcgggugcucggagcgcuugccgcuggaccacagcggcgaccagccuucgcgcuugccggugacc

SEQ ID NO: 58796 - RNA, 72 nt, Pseudomonas aeruginosa PA01
ggacgugccgcgcgaggaacgcggcggacgcgggcacacgccgcgccagccgaccgacucgccgcucuaccc

SEQ ID NO: 58797 - RNA, 89 nt, Pseudomonas aeruginosa PA01
ggacguggugaagcgcaacaucggugccaugggcgggcgcaucgacaucgacucggcgcccggcaugggcacucgcaucggcauccgcc

SEQ ID NO: 58798 - RNA, 113 nt, Pseudomonas aeruginosa PA01
gcugugcccgucgaacucggagacccagauggccagcgcguccgggucaugggcguggguuugcgccacggucucgacgcuggcguucgggaucgccugggcggcgggccagc

SEQ ID NO: 58799 - RNA, 116 nt, Pseudomonas aeruginosa PA01
gcugguuccccgcucagggcgccgacagcggacgauaggcgagcaucagcgggacgucggcagcgugcgcgaccuguaccaguucgcuggccaggcgcccaccgggaaacaccagc

SEQ ID NO: 58800 - RNA, 73 nt, Pseudomonas aeruginosa PA01
gcuguucgacuucggccgccgcagcgccgcccugcgcaacgcccagcaguugcugcuggcggccaacgccagc

SEQ ID NO: 58801 - RNA, 94 nt, Pseudomonas aeruginosa PA01
gcuguugcgcguauugcaggagcgcgagguggagcgggucggugcgcgcaaaccgaucaaccuggauauccgcgugcuugccacgaccaaccgc

SEQ ID NO: 58802 - RNA, 94 nt, Pseudomonas aeruginosa PA01
gcuguugcuguggagcgcgccgaaucccugggucggccuggccggcgcggcccucaccggcuucggcuucucccugguguucccggcguucggc

SEQ ID NO: 58803 - RNA, 63 nt, Pseudomonas aeruginosa PA01
gcuguugucgagcagcacgccgacacugcggcaggcaugcgcggcgaucugcucggcgagggc

SEQ ID NO: 58804 - RNA, 56 nt, Pseudomonas aeruginosa PA01
gcuuccagccggccgcuuccagcgccugccagucgcgcgcggccgguucgggaagu

SEQ ID NO: 58805 - RNA, 69 nt, Pseudomonas aeruginosa PA01
gcuucgcgaucggcggguugccagcucagcagguagcuggcgagcagggcaccgccgaccagcaggagc

SEQ ID NO: 58806 - RNA, 55 nt, Pseudomonas aeruginosa PA01
gcuucgcgucccgcgcgcgguccgcagccgagcgccgagcgcaaggggcgcgagc

SEQ ID NO: 58807 - RNA, 111 nt, Pseudomonas aeruginosa PA01
gcuuccgcagguugagcgccccccuggacgcgccguugcgcugguucgccgguaaccacgacgaacgcgagccgaugcaacgggcgaccgagggcagcgaccuguuggagc

SEQ ID NO: 58808 - RNA, 56 nt, Pseudomonas aeruginosa PA01
gcuuccgggcaauucggcgaggcggacaucaagucgcgcuucgucacccuggaggc

SEQ ID NO: 58809 - RNA, 61 nt, Pseudomonas aeruginosa PA01
gcuucaagcccgccggcgaccagccggaagccauccggcagauggucgaggggcuggaggc

SEQ ID NO: 58810 - RNA, 76 nt, Pseudomonas aeruginosa PA01
gcuugccgacaggcgcgcgccgcuaggguguccgcaucgccgcaccgcccuggcggggccgcgacuucccggcugc

SEQ ID NO: 58811 - RNA, 59 nt, Pseudomonas aeruginosa PA01
gcuuggcgcacugcgcgaauucgcccggcugcagggccugucgcugcaacacgucaagc

SEQ ID NO: 58812 - RNA, 78 nt, Pseudomonas aeruginosa PA01
gcuugaggauuuccugguuguagcgagcgcccaugccgaguuccugcugcucgcucaucaucacgaaaucgcucuugc

SEQ ID NO: 58813 - RNA, 58 nt, Pseudomonas aeruginosa PA01
gcuucuguggcagcgccgugggcaggccgcggccgcuccaggcagugaccacaagggc

SEQ ID NO: 58814 - RNA, 55 nt, Pseudomonas aeruginosa PA01
gcuucuucgagcagggcaagggcgccaaugucaccgugccguucaaggaagaggc

SEQ ID NO: 58815 - RNA, 86 nt, Pseudomonas aeruginosa PA01
gcuugucgcuggcgacgccgaggcgacgcagggucacguacuuggcgauggcguaguccucgcagucggcggcgcccuugaccagc

SEQ ID NO: 58816 - RNA, 109 nt, Pseudomonas aeruginosa PA01
gcuugugcagggucucgcugucgcagucccagccgcgcgccgcgcauuccugcuggauugccggagucuucgccugguugggaauggcgaagccggccaggguguaggc

SEQ ID NO: 58817 - RNA, 61 nt, Pseudomonas aeruginosa PA01
ggaaagcuggaacggauagugcucggcgaaaccggcgaggugacacuucuccagcauuucc

SEQ ID NO: 58818 - RNA, 81 nt, Pseudomonas aeruginosa PA01
gccggugguccuggccugcgggucgagcugggcgcugaccaggaagcgcgcgucggccggcaggcucucggcgaccucggu

SEQ ID NO: 58819 - RNA, 64 nt, Pseudomonas aeruginosa PA01
gccgguguucgacaggacucgcugcaagccuuccaguacgcuguagcgacccuugagcgccggc

SEQ ID NO: 58820 - RNA, 65 nt, Pseudomonas aeruginosa PA01
gccguagcgcauuuccugggccuugacgaacugacuguugaaggugcgcgggaaggcgccgcggu

SEQ ID NO: 58821 - RNA, 69 nt, Pseudomonas aeruginosa PA01
gccguaggccaggaucgagagcaggaugugggccaggaugcccggcuguucguugaucggcucgacggu

SEQ ID NO: 58822 - RNA, 88 nt, Pseudomonas aeruginosa PA01
gccggucaaccugaucaugggcugcuacggcaucggcguaucccgcguggucgccgccgccaucgagcagaaccaugacgagcgcggc

SEQ ID NO: 58823 - RNA, 91 nt, Pseudomonas aeruginosa PA01
gccggucagcagcggcgcauagcuccagccgaagccuucgaguucgcgcuggggccccggcgguggagugaugccgcugcgguagaucggc

SEQ ID NO: 58824 - RNA, 72 nt, Pseudomonas aeruginosa PA01
gccggucgcgcucgcgguaagguaugcccgcuuuuccuuccguugcgguguauuccguggagugucgccggc

SEQ ID NO: 58825 - RNA, 56 nt, Pseudomonas aeruginosa PA01
gccgggagugaagaaggcgaugaugaacagcgccggcuuccaccugcucgaccggc

SEQ ID NO: 58826 - RNA, 89 nt, Pseudomonas aeruginosa PA01
gccggggaaagcaagagccugcugcgccgggcccugcgcgggcaccugccgcaggcgauccuggagcggcgcaagagcgguuucccggc

SEQ ID NO: 58827 - RNA, 56 nt, Pseudomonas aeruginosa PA01
gccggggccggcgaucuugcuggcgaggauccagucggcgcggucgccgcugcggc

SEQ ID NO: 58828 - RNA, 84 nt, Pseudomonas aeruginosa PA01
gccggggucuucgagcgcagcaaugccaccgugcaaccagccuugcuggugcaaggcaugcgccgcguggcgcuggcccucggc

SEQ ID NO: 58829 - RNA, 57 nt, Pseudomonas aeruginosa PA01
gccggcggcggacgccagcagcgugucgugcagcgggaugcugaauucgccgccggc

SEQ ID NO: 58830 - RNA, 78 nt, Pseudomonas aeruginosa PA01
gccggcgaucaccaggcucgcggaugcgcgcaggucggucgccaugaccggagcgcccuugagcuuggguacgccggu

SEQ ID NO: 58831 - RNA, 73 nt, Pseudomonas aeruginosa PA01
gccggcgccgccucgggcagccccuugagcgcguuguagaaacgguccagggccgccuuggccucgcgcaggu

SEQ ID NO: 58832 - RNA, 69 nt, Pseudomonas aeruginosa PA01
gccggacgccccggagcuggucaaccaggacccgcucggcgaggccugguucuuccgcuuccguccggc

SEQ ID NO: 58833 - RNA, 69 nt, Pseudomonas aeruginosa PA01
gccggacggaagcggaagaaccaggccucgccgagcggguccugguugaccagcuccggggcguccggc

SEQ ID NO: 58834 - RNA, 65 nt, Pseudomonas aeruginosa PA01
gccggagaucaccgagccguccgaggggaucagcaccucgaagcgcuccgggucgaucugcuggc

SEQ ID NO: 58835 - RNA, 58 nt, Pseudomonas aeruginosa PA01
gccggagcugccggccgaccugucggcgaugcccuacgucggcugggagcguucgcgc

SEQ ID NO: 58836 - RNA, 63 nt, Pseudomonas aeruginosa PA01
gccggccgagaaggucgcguagucggccugcggauccuugaacgcgaagccuucgcgggcggc

SEQ ID NO: 58837 - RNA, 74 nt, Pseudomonas aeruginosa PA01
gccggcgaagggcgggaacugcgcgcgcagcgggugggccucgaacuggcgcagcaguuccucgccgagcuggc

SEQ ID NO: 58838 - RNA, 86 nt, Pseudomonas aeruginosa PA01
gccggcgagcaggcgcaguuggacgcccgcuuccccggccguagccguuucgacacgcgcgcgccgacuggcgccuggacuucggc

SEQ ID NO: 58839 - RNA, 57 nt, Pseudomonas aeruginosa PA01
gccguuccagcggcggaugagcgcagcucgauuccuccgccgcagccgcuggacggc

SEQ ID NO: 58840 - RNA, 91 nt, Pseudomonas aeruginosa PA01
gccguugcugcugcagguguuccagggcuucggcgagucgcaguuguuccucgcgcagcgaauccaggggcgccuggagcgucucgacggc

SEQ ID NO: 58841 - RNA, 57 nt, Pseudomonas aeruginosa PA01
gccguuucgcuggucggcccgucggcgaaaaacagcaaccagaccagcgccagcggc

SEQ ID NO: 58842 - RNA, 74 nt, Pseudomonas aeruginosa PA01
gccgugguagccgguggggaggauguccgaaaggcaggucaggucgcggaucuucuccaucgccgcuucgcggu

SEQ ID NO: 58843 - RNA, 59 nt, Pseudomonas aeruginosa PA01
gccgucucgcuggaacgggguuccgacaaccuucggcuccgccgccucagcggggcggu

SEQ ID NO: 58844 - RNA, 56 nt, Pseudomonas aeruginosa PA01
gccgucgauccucgccgcguucuacaccgaggacgccggccuggagggcgcucggc

SEQ ID NO: 58845 - RNA, 68 nt, Pseudomonas aeruginosa PA01
gccucgucgcgcaggacgguaaccgaaagcgucacgcugagcggcgagccguccuugcgcagauaggu

SEQ ID NO: 58846 - RNA, 82 nt, Pseudomonas aeruginosa PA01
gccugacccgcgccgaggagaucgccgccagcgaucgcgcggcggcggcgcggcguacgcuggaggcgaugcucgggcaggc

SEQ ID NO: 58847 - RNA, 126 nt, Pseudomonas aeruginosa PA01
gccugaccgggcaucgcgcggaggccguggcguucgguaccgaggcgccguacuuccagcgccugggcagcgagacccugguccucggugccggcgacaucgccugugcccaccagcccgacgagc

SEQ ID NO: 58848 - RNA, 72 nt, Pseudomonas aeruginosa PA01
gccuauucgcugaucgccgacagcuucccgcgcgagcgucgggcgacggcgaucagcgucuacucgaugggc

SEQ ID NO: 58849 - RNA, 57 nt, Pseudomonas aeruginosa PA01
gccugagcgagacucaggacacugcgccgaggucguugucgcggguuuccuucaggc

SEQ ID NO: 58850 - RNA, 86 nt, Pseudomonas aeruginosa PA01
gccugauccaccggcccgccgggugcggccuggacgauggcgaaguugaucagcaggaugcccagcagggucggcaggaucagcgc

SEQ ID NO: 58851 - RNA, 77 nt, Pseudomonas aeruginosa PA01
gccugcgcaucggccuggucgaagcccuggcgccgcacggccuggccgagcgcuucgcccaugucggcgcgcaacgc

SEQ ID NO: 58852 - RNA, 55 nt, Pseudomonas aeruginosa PA01
gccugcgucgugcccuggcccgccauccgcucggccaggccugcuacccgcuggc

SEQ ID NO: 58853 - RNA, 83 nt, Pseudomonas aeruginosa PA01
gccugcucgaacgcggcuucgucuuugccaucgcccauguccguggcggcggcgaacugggcgaagccugguaccgggccggc

SEQ ID NO: 58854 - RNA, 111 nt, Pseudomonas aeruginosa PA01
gccgccaucccagggcacgccgaucaggccgaccugcagcgccgccgggucggugaacgccggcaggcgcaugaaggucgggauaccggcgaagcggggaaucucggcggc

SEQ ID NO: 58855 - RNA, 102 nt, Pseudomonas aeruginosa PA01
gccgcaucucggcuccuccugugggcuccgacuaucacucgaugaugaugaaauccuugaggugcucuucggauaucuccaggcccaggccgggcuuguggu

SEQ ID NO: 58856 - RNA, 67 nt, Pseudomonas aeruginosa PA01
gccgccacccugagcgcgcugaucgcccgcagcuucggcaccgaggucagccugcucggccuggcgc

SEQ ID NO: 58857 - RNA, 81 nt, Pseudomonas aeruginosa PA01
gccgaugccuucgaucacaccggaauacaucggcgaacgaucgagauuggcggcgaugaucucguggguccgggcguuggu

SEQ ID NO: 58858 - RNA, 88 nt, Pseudomonas aeruginosa PA01
gccgcaacaggucgucgagcgccgcuucgucaggaucggcgaacgccgcgaaggccuggcgguggugcucgaaggccuugagggcggc

SEQ ID NO: 58859 - RNA, 120 nt, Pseudomonas aeruginosa PA01
gccgccgcggugggcgauuucugcgccgagcggcgggugcugcuggaccuugugguggaggaccaggaggucgggcucaagcgcaugcgcgcgggcgaaguggccggcugcgucugcggu

SEQ ID NO: 58860 - RNA, 76 nt, Pseudomonas aeruginosa PA01
gccgccggacguaccagccggcggccuguuccccgccuucgccgggaucgccaccggccugguagcgcuggccggc

SEQ ID NO: 58861 - RNA, 111 nt, Pseudomonas aeruginosa PA01
gccgccgagauuccccgcuucgccgguaucccgaccuucaugcgccugccggcguucaccgacccggcggcgcugcaggucggccugaucggcgugcccugggauggcggc

SEQ ID NO: 58862 - RNA, 60 nt, Pseudomonas aeruginosa PA01
gccgccgaggcugaugcgcugcgggcugaacagcacguccucgcuccucugcccgguggc

SEQ ID NO: 58863 - RNA, 93 nt, Pseudomonas aeruginosa PA01
gccgccgaugaccacgaaggccaucugcauggugaacgggaucaggcuccagaaaccgucgccgaaggcuuucgccguggcggucgguccggc

SEQ ID NO: 58864 - RNA, 56 nt, Pseudomonas aeruginosa PA01
gccgcgggcacucauguuggccugguugaagaagauccggccgaagugcucgcggu

SEQ ID NO: 58865 - RNA, 57 nt, Pseudomonas aeruginosa PA01
gccgcgcaguucuccgccuuucucuuccaugagcugggcgaccugaacugggccggc

SEQ ID NO: 58866 - RNA, 107 nt, Pseudomonas aeruginosa PA01
gccgcucugcaggucgagguugccggcccggcuguccaggcggccgcccugguuguccagcgcgccgccgauacgcagccgguugucgcccugggccuggagcgugc

SEQ ID NO: 58867 - RNA, 58 nt, Pseudomonas aeruginosa PA01
gccgcuggccaggcccucgccgagggcccuggccgucugcaggaagccuggcagcagc

SEQ ID NO: 58868 - RNA, 55 nt, Pseudomonas aeruginosa PA01
gccgcggucggccagcaggcgcagccagcgcaguuucagccagccgaucugcggc

SEQ ID NO: 58869 - RNA, 121 nt, Pseudomonas aeruginosa PA01
gccgcucgacgccgacugccaggcccugaugaugcgccgccuggaagccgccggcuucgcccuggagccgaugcgcaucgaggagguggacaacuucugggcacggcgcggcggcgacggc

SEQ ID NO: 58870 - RNA, 64 nt, Pseudomonas aeruginosa PA01
gcccugcgccugggccuucuucugcaggccggcgaggcaggaagggaagcucgaggcgucgggu

SEQ ID NO: 58871 - RNA, 74 nt, Pseudomonas aeruginosa PA01
gccgagcauguugcugucuucgccggugcucaucggccgccccagcaccagguaggacagcgccugcuccuggc

SEQ ID NO: 58872 - RNA, 58 nt, Pseudomonas aeruginosa PA01
gccgagcgagaacguuccgccgaccuacuucucuucggucagcccggaacuguuuggc

SEQ ID NO: 58873 - RNA, 84 nt, Pseudomonas aeruginosa PA01
gccgagcgccgcgagcaggccgcugacugcgccgagcagggcgaacucgacccgccggguacguugcagcaacucgcgcucggc

SEQ ID NO: 58874 - RNA, 57 nt, Pseudomonas aeruginosa PA01
gccgagcgcgcccucgaacugaugugcaagcgcgcggucagccguaccgcguucggc

SEQ ID NO: 58875 - RNA, 57 nt, Pseudomonas aeruginosa PA01
gccgaggaauuuccccgcgaacucuaucucaaggccggcgcggccgggauccucggc

SEQ ID NO: 58876 - RNA, 89 nt, Pseudomonas aeruginosa PA01
gccgaggccgacggcgagcgccaggugauccucggcagcaccccgcugcucgacgccgacgccgcgcucgccgcgcucgacgccgcggu

SEQ ID NO: 58877 - RNA, 98 nt, Pseudomonas aeruginosa PA01
gccgaggcgcauacugugcaacugcgucugcugcgcgagggcgacgagcugugccugagcgucagcgacgacggucgcggguucgauguugccacggu

SEQ ID NO: 58878 - RNA, 57 nt, Pseudomonas aeruginosa PA01
gcccuggaagaccugccggagaagcucgaaggcuucgacacgguauucuccaugggc

SEQ ID NO: 58879 - RNA, 63 nt, Pseudomonas aeruginosa PA01
gcccuggaccuggcggugaagagccgcgagcgcgugcgcugaggcguuccgccggcccggggc

SEQ ID NO: 58880 - RNA, 88 nt, Pseudomonas aeruginosa PA01
gcccuggcgauugcccuccaggaacgggcccaggcgcagggcgcccuggaagugcuguuccuggacaagcagggcgacuaccgcuggc

SEQ ID NO: 58881 - RNA, 97 nt, Pseudomonas aeruginosa PA01
gcccuggugguugcgcgcacccucccgcugcucgaacucgcagacgauguccaguuccuccagcgcggcgaugguguccugugcgguacgccggggc

SEQ ID NO: 58882 - RNA, 63 nt, Pseudomonas aeruginosa PA01
gcccuuggccagguugaucuguccggcgucgcugaagauguacucgcgggcaagcuuggcggc

SEQ ID NO: 58883 - RNA, 62 nt, Pseudomonas aeruginosa PA01
gccgaagcugguggcgcggcugcaggaguugccgcagcucgccgacgucgccagcgacuggc

SEQ ID NO: 58884 - RNA, 76 nt, Pseudomonas aeruginosa PA01
gccgaaggugaugcgcuccagggcggcgcggacgaaguccgguaccggcacgaagcucuugcggaucgccuucggc

SEQ ID NO: 58885 - RNA, 78 nt, Pseudomonas aeruginosa PA01
gccgacagaagaaccggcggguggaagucugggucuacugaacgcuguagcacuuuguaaccucgccguuuugccggc

SEQ ID NO: 58886 - RNA, 88 nt, Pseudomonas aeruginosa PA01
gccgacagcgccuaugaacggcugcuggagcgccugggccaggccaucgcccacggccuggcccagcucgggcacgcugcgcuguggc

SEQ ID NO: 58887 - RNA, 56 nt, Pseudomonas aeruginosa PA01
gccgaccaggccggugaguccgcccugggguaccagggcgcgucccgccuggcggc

SEQ ID NO: 58888 - RNA, 62 nt, Pseudomonas aeruginosa PA01
gccgaccggcucgucuuccgggcccugccgccaacggcuuccggauagcgcgucgacgcggc

SEQ ID NO: 58889 - RNA, 81 nt, Pseudomonas aeruginosa PA01
gcccugaucgccgguugaugcggguuccgguaggggaagcgccgugcuuccucugucgguucgcauaggucggcgcguggc

SEQ ID NO: 58890 - RNA, 60 nt, Pseudomonas aeruginosa PA01
gcccauggcgaaagcgccgccgaucagccaggagagcgccucgcggccuuucgccagggu

SEQ ID NO: 58891 - RNA, 65 nt, Pseudomonas aeruginosa PA01
gccccagguguucggcaucggccgccagcgccccgaggccguggccgggaucgagcaacuggcgc

SEQ ID NO: 58892 - RNA, 58 nt, Pseudomonas aeruginosa PA01
gcccaggcgccguugcgcgaggcuuuccagcuggagagcgaggccaggcgccuggagc

SEQ ID NO: 58893 - RNA, 79 nt, Pseudomonas aeruginosa PA01
gcccaggcgggcagucucagugucugcggugcucggcgaagcgcuccagggcuucgcggcugaggcgcucgaccugggc

SEQ ID NO: 58894 - RNA, 75 nt, Pseudomonas aeruginosa PA01
gcccagggcgaggaauucgccuugcugcgcgacgcccuggccgggcgcccggaagcgcggguccucgaccugggc

SEQ ID NO: 58895 - RNA, 106 nt, Pseudomonas aeruginosa PA01
gcccccugguuggcgcugaccaggaccaguugcgcggccucgccgacaugcgcgagacagcagacgacgagcgcgagcagcgccuggaaagcccgacgggcggggc

SEQ ID NO: 58896 - RNA, 93 nt, Pseudomonas aeruginosa PA01
gccccggcggacagccugccggcccugguggcggcggucgagcaggccggcuaccagguuccggcgcgcagccuggaacuguccaucgagggc

SEQ ID NO: 58897 - RNA, 89 nt, Pseudomonas aeruginosa PA01
gccccgggagagcggccgccggcgcuggagcgccucggcgaacugaucgccgaggaguuccggcucugagccgcuacagcgccgggcgc

SEQ ID NO: 58898 - RNA, 59 nt, Pseudomonas aeruginosa PA01
gccccgguguagggaucaauccagcgcgacucgccgcggcgcugucccggcggcggggu

SEQ ID NO: 58899 - RNA, 100 nt, Pseudomonas aeruginosa PA01
gcccaguugguaaucguagacgcgcacgucaccguccuucggccgcaccaggaugcgguugccggagacgauggcgacguucugcucgcugcccgacggc

SEQ ID NO: 58900 - RNA, 68 nt, Pseudomonas aeruginosa PA01
gcccgaauggccgcggauacccgucgaaggcgccagugcccgcgacuggaauccgcgaaccuucuggu

SEQ ID NO: 58901 - RNA, 86 nt, Pseudomonas aeruginosa PA01
gcccgagcgggcguuugcggcgaccugccggcguugugaagccgccggcaaaaacgccgccuuuuuccgcgaaacgccgcucaggc

SEQ ID NO: 58902 - RNA, 60 nt, Pseudomonas aeruginosa PA01
gcccggcgcaggguauggcgguucaccgcgaagcgcugggccagcuggaucucgccgggc

SEQ ID NO: 58903 - RNA, 56 nt, Pseudomonas aeruginosa PA01
gcccggcuucccggcggaaagucucgagguccugggcuucgccgugauagccgggc

SEQ ID NO: 58904 - RNA, 61 nt, Pseudomonas aeruginosa PA01
gcccgguaccgcgcuugaucacguccugcagcaugcuggucaugauauaggcgguacgggc

SEQ ID NO: 58905 - RNA, 103 nt, Pseudomonas aeruginosa PA01
gcccgccaucguucgccgcagacccugguggugcucggucgcgacaucgggcggcccggugagcgccugcugcgcaccacccugggcgagcugcgugcggagc

SEQ ID NO: 58906 - RNA, 55 nt, Pseudomonas aeruginosa PA01
gcccucgccgacgaccugcgccgagcgccggguagcuucgccgagcgagcacggc

SEQ ID NO: 58907 - RNA, 61 nt, Pseudomonas aeruginosa PA01
gccaucgucauccucggugccggccggcagaccaacgacccggccuggggcgacgaugcgc

SEQ ID NO: 58908 - RNA, 82 nt, Pseudomonas aeruginosa PA01
gccaguucgucgacccguccgggcagcucgccggaaagcuggccgagcagguguugcaggcgggucugguugacguacuggu

SEQ ID NO: 58909 - RNA, 69 nt, Pseudomonas aeruginosa PA01
gccauccagcgccagcggaauccccgagacgcgacucaccgcgcucuggaacgcggcguugcgacuggc

SEQ ID NO: 58910 - RNA, 129 nt, Pseudomonas aeruginosa PA01
gccaucgagcaucagguugcggucgagcgccucgaagcguacgccgccggcgcugcugaucgcuucguccagcggacgcgggcgcagcagcgucagcggcaggcgcuugaucgccgccgccaggcgggc

SEQ ID NO: 58911 - RNA, 75 nt, Pseudomonas aeruginosa PA01
gccauuucgccgaagccggcgccaugcgucauggccugacgccacgcgaacuggacgccggccagucggcgcggc

SEQ ID NO: 58912 - RNA, 66 nt, Pseudomonas aeruginosa PA01
gcccagcuggaugcucgcgcucagcucgugcaacacacuucgcucgcgauugccguccagccaggc

SEQ ID NO: 58913 - RNA, 78 nt, Pseudomonas aeruginosa PA01
gcccagcagcuuccagccggcggaauacuucggguccugcucuacgcagcgcuggagguguuccgccgcgcguucggc

SEQ ID NO: 58914 - RNA, 66 nt, Pseudomonas aeruginosa PA01
gcccagcgcgcacgcacacccagcucgucgaucaacgcucgguagguggcguugucgcgcuggcgc

SEQ ID NO: 58915 - RNA, 105 nt, Pseudomonas aeruginosa PA01
gccagcgagccgccagcggcguccgccccgcucugcgccaacggccacccgcugcaacccggcgaccugaugugccuggagugcggcgccgcgccggccgaaggc

SEQ ID NO: 58916 - RNA, 130 nt, Pseudomonas aeruginosa PA01
gccaggaugcguuccagcucgccgcgcaucagcgccugccgcgccucgucguacuugcgccagcgggucagcggcaccagcaggcgcgaggcgaucugcggguugagugcguugagcacgaucaccuggu

SEQ ID NO: 58917 - RNA, 76 nt, Pseudomonas aeruginosa PA01
gccaggcaaugggcgagccacucgccgaggaacagguugagcugguucuucucgucgggcuggugcaucgccuggu

SEQ ID NO: 58918 - RNA, 69 nt, Pseudomonas aeruginosa PA01
gccaggccgcacgccuggucgggcucggcgccagcgccgaagaccugacccaggccugcggucugucgc

SEQ ID NO: 58919 - RNA, 56 nt, Pseudomonas aeruginosa PA01
gccaggcgccgggccgcuccgccgaccugucgcggucggucggcgaggcgccuggc

SEQ ID NO: 58920 - RNA, 80 nt, Pseudomonas aeruginosa PA01
gccaggcgcgagagggcgcggcgaaugauggugcggcugacaccgaauaucucgccgagcgccuccucgcucagcuuggu

SEQ ID NO: 58921 - RNA, 56 nt, Pseudomonas aeruginosa PA01
gccagggcgcguaacugguggucgaacuccugcuguucggugaguacgcgcuuggc

SEQ ID NO: 58922 - RNA, 97 nt, Pseudomonas aeruginosa PA01
gccaccgcugggcggugggcgagagcggcuucgacccggcgggggcgaccuacgcgccggccgccgaggucgccaauggcuaccgccgagccauggc

SEQ ID NO: 58923 - RNA, 88 nt, Pseudomonas aeruginosa PA01
gccacgcggcggaggugaucaagcgccugcgcgccuuccugcgcaagggccagcggcgccugcaggcgcucgaccucaaccagguggc

SEQ ID NO: 58924 - RNA, 108 nt, Pseudomonas aeruginosa PA01
gccacggccuggcugaaccuguuccaguuggcggcguugcagcccggcgagaaagugcugcugcacgccggcgccagcggcgucgguucggccggcauccaauugugc

SEQ ID NO: 58925 - RNA, 57 nt, Pseudomonas aeruginosa PA01
gccacggcggcggccagcgcguuccgccaauggguggaagcgcgguucgccgcuggc

SEQ ID NO: 58926 - RNA, 60 nt, Pseudomonas aeruginosa PA01
gcaugccguucgccgcguacuuggucaguucggcgcugcgcaggcccaugaacagcaugc

SEQ ID NO: 58927 - RNA, 130 nt, Pseudomonas aeruginosa PA01
gcauggcggcgucgagacuggucagccgguguucgcgaauggccuugcggaucugcccgugguugaggucgcugcagccgcagauggccuucucgcucuucggcuugacgucggcggcgccgccgacggu

SEQ ID NO: 58928 - RNA, 76 nt, Pseudomonas aeruginosa PA01
gcauucaccgccgcccucuugcggcgaaccccucuuaugucaggguucacaaggccgccgagggcuggaagaaugc

SEQ ID NO: 58929 - RNA, 77 nt, Pseudomonas aeruginosa PA01
gcaggugguuuccgcagucuucagcaugccgcgucccuggcagcaggggcacggcucgcagaggaucugcaccaggc

SEQ ID NO: 58930 - RNA, 80 nt, Pseudomonas aeruginosa PA01
gcagggccucguccagcgccaggccgaacucuccggccagggccucgagacucugccggugcaacuggucgaggugcugc

SEQ ID NO: 58931 - RNA, 80 nt, Pseudomonas aeruginosa PA01
gcagguacuccagggccuggcgcccgucguugagcgcggucauuuccacgccgaccgccuccaggcaacggauuaccugc

SEQ ID NO: 58932 - RNA, 63 nt, Pseudomonas aeruginosa PA01
gcaggucgcgcacguucuggcuguugaugaagaccaucccggccucgaugccgcgugccaggc

SEQ ID NO: 58933 - RNA, 95 nt, Pseudomonas aeruginosa PA01
gcaggucgcgucgaaaaccuucaggccgcgccccucggcuuccuugcggaccgccugggaaacgccgugggcgcugaagaugacgaugacguugu

SEQ ID NO: 58934 - RNA, 78 nt, Pseudomonas aeruginosa PA01
gcauccgucgcccguccugccucguccgcgcagcgcucgccgcuguccauccgggcgaggcgggcgugcccaccaugc

SEQ ID NO: 58935 - RNA, 97 nt, Pseudomonas aeruginosa PA01
gcaucgaccugucggugagcuggcaggcgcucugggaugaucacgcaguaguggcgcggguggucuucgagcguccgcagcucaacuucgucgaugc

SEQ ID NO: 58936 - RNA, 57 nt, Pseudomonas aeruginosa PA01
gcaucgcgccggguuucaucgucgccaggcgcugcgcgucgaugagguggcgggugu

SEQ ID NO: 58937 - RNA, 84 nt, Pseudomonas aeruginosa PA01
gcaucgguuccaaagcaggaugccugaagaccucguccgguuggccuacccagcggcacagaggccgggcccugagcccgaugc

SEQ ID NO: 58938 - RNA, 130 nt, Pseudomonas aeruginosa PA01
gcaucagucauccucccggcggacguucagugaccaguccugcccaucggugcgcaggucgaacaggaucggccggcagcacaccgggcaguccucguaguacugcuggucgccggcgcucaggucgagc

SEQ ID NO: 58939 - RNA, 99 nt, Pseudomonas aeruginosa PA01
gcaucaaggucccggacggcccgcugaccucgcgccugcagcaccugaaggaaggcgacgagcugauggucagccgcaagccgaccggcacccuggugc

SEQ ID NO: 58940 - RNA, 95 nt, Pseudomonas aeruginosa PA01
gaugaaacguuugagcggagcucccaggcgucgccuggcgcaugggggcgccgggcgauagccggggagauggacccugaaugauagguuuuauc

SEQ ID NO: 58941 - RNA, 78 nt, Pseudomonas aeruginosa PA01
gaugaggaugcccggggacaugucguccagcccgcugagcacgguggagccgguggcggugauucccgacaugcuuuc

SEQ ID NO: 58942 - RNA, 73 nt, Pseudomonas aeruginosa PA01
gauccggcgauccgcgucaucgugcucaccggcgacucgcgcugcuuugcagcuggcgccgaucuccgcgauc

SEQ ID NO: 58943 - RNA, 80 nt, Pseudomonas aeruginosa PA01
gauccuuuccaauauugacacugaacgagccggaguuauugccauagguuccgggcacgucguuguagauaagagugauu

SEQ ID NO: 58944 - RNA, 106 nt, Pseudomonas aeruginosa PA01
gaucaccauggucgagaucgacggcaccguggucgacaugugcaaggaguuccugcccaaccacucccagggcgccuucgacgacccgcggcugaaccuggugauc

SEQ ID NO: 58945 - RNA, 85 nt, Pseudomonas aeruginosa PA01
gaucgccuggaauuccuugucccgcgccugcuucgccgagccgccggcggagucgcccucgaccaggaacaguuccgcgcgcauc

SEQ ID NO: 58946 - RNA, 91 nt, Pseudomonas aeruginosa PA01
gaucgccuuccgcccgcgcugcuccuaucgccugcugcuggaguccugguucgccagcgcgcgagugagcaugggccgggugauggagauc

SEQ ID NO: 58947 - RNA, 60 nt, Pseudomonas aeruginosa PA01
gaucgcgugguggacaucgacggcggccuccugcuguccggcgacacccucuacgugguc

SEQ ID NO: 58948 - RNA, 91 nt, Pseudomonas aeruginosa PA01
gaucgggccgagcaggccggcuaccucgaaggcggugggaacgaucgccgcgccgaccuugccgagcgccggcaugcguucguagacgauc

SEQ ID NO: 58949 - RNA, 55 nt, Pseudomonas aeruginosa PA01
gaucucgaggaugcggccggagaagauguucuucuugcccuucuucucgacgguc

SEQ ID NO: 58950 - RNA, 57 nt, Pseudomonas aeruginosa PA01
gaucucgccguugcgcuggccuucgcuccaaccgcgggaaaucagcucggugagguu

SEQ ID NO: 58951 - RNA, 81 nt, Pseudomonas aeruginosa PA01
gaucucggugauggagccguccucgccggccuggucuucgguggcaaggucgagcaggcgcagggcggcuucgccgaaguc

SEQ ID NO: 58952 - RNA, 81 nt, Pseudomonas aeruginosa PA01
gauaccguuccaggccgagcgcgaagccuuguccuaugagauagaggugaauggccagcgcgucgaacuggccgcgguauc

SEQ ID NO: 58953 - RNA, 94 nt, Pseudomonas aeruginosa PA01
gauccaggugcgcguggguauggaugaugcugaccaccugcaggccgaggcggucgaggcgcugcaggaucaguucguggucgccgcccggauc

SEQ ID NO: 58954 - RNA, 103 nt, Pseudomonas aeruginosa PA01
gaucccaccaucgccgcacgacagcgcuggaugggcgugcucgcccgcgcccgucgcgaggagcuggacgcccaugcggacgcccugcgcgaugccgacuauc

SEQ ID NO: 58955 - RNA, 126 nt, Pseudomonas aeruginosa PA01
gauccccuggccgaccgugccagcaccgugugcgccgggguuuccggcgugcuuuucgccaucgaacggaugcgcuacgcgcagccgggacucuggcuggccaagguggccggucgucaaccgauc

SEQ ID NO: 58956 - RNA, 61 nt, Pseudomonas aeruginosa PA01
gaucagcgccacgguggcgccggugauugaggcggugcgggugccgccgucggccuggauc

SEQ ID NO: 58957 - RNA, 61 nt, Pseudomonas aeruginosa PA01
gaucagcucggcgccgcguagcgugccgucgucguccaggcgcgccggcgccgggcugauc

SEQ ID NO: 58958 - RNA, 93 nt, Pseudomonas aeruginosa PA01
gaucaggcucacguagggcaccuggaacucguggcgcaggcuguccucgacgguacugaccacgucuuccaggcugguggcgucgagcagguc

SEQ ID NO: 58959 - RNA, 77 nt, Pseudomonas aeruginosa PA01
gaggcuguccggggucggguuggcugggguguuccggcucaugccauccugcucgaucacggccugguucauguuuc

SEQ ID NO: 58960 - RNA, 61 nt, Pseudomonas aeruginosa PA01
gaggcuugcgcugggcccagccgcucucacggaaggcgcggugggcgccggccauggccuc

SEQ ID NO: 58961 - RNA, 93 nt, Pseudomonas aeruginosa PA01
gaggucgaggucgcagggcagcucgaggucuucgucgcuggccagcacgcgggugaugugcgccuugagcugcucgagggaagucucgaucuc

SEQ ID NO: 58962 - RNA, 69 nt, Pseudomonas aeruginosa PA01
gaggccccgggccggcggaacgccucagcgcacgcgcucgcggcucuucaccgccagguccagggcuuu

SEQ ID NO: 58963 - RNA, 58 nt, Pseudomonas aeruginosa PA01
gagcucgcucuggaugcgcguccgcacaugcuggaagaccgccaucagcgcgggcauc

SEQ ID NO: 58964 - RNA, 129 nt, Pseudomonas aeruginosa PA01
gaggacgaccaguucgccguccagccaacugcgcugcagaccgagcccggccaaggccuucuccagguguggcaggcguucgguccagucauggccguugcgggucagcaggcgcacguggccgucuuc

SEQ ID NO: 58965 - RNA, 129 nt, Pseudomonas aeruginosa PA01
gagcuggcgcggcacccggcgcuggaugauggucggguagucgucgggguucuucaaugcgucgauaagccccucgcggaucucggcgaugcgcuccggguuguugccgauggagucgccgucggcguc

SEQ ID NO: 58966 - RNA, 90 nt, Pseudomonas aeruginosa PA01
gagcuaggcccggacgcucgguaacgugggcgcauuuucgauggagucuucccuaugcgcccugcccgucugcuggucuacagccugcuc

SEQ ID NO: 58967 - RNA, 86 nt, Pseudomonas aeruginosa PA01
gagcgccgggaggauccgccagggugucgcgcauugccgcgagguggcgccggugcuguuccuguugcucgauuaccuggcgcauc

SEQ ID NO: 58968 - RNA, 63 nt, Pseudomonas aeruginosa PA01
gagcgcgaggaacgucaggacacgcaggugcuugggcauaacgacuucuuacuucuucagcuc

SEQ ID NO: 58969 - RNA, 59 nt, Pseudomonas aeruginosa PA01
gagcgcugcaagccggcgaguccuucgggaaucgccaggacgaagggcuugccgcccuc

SEQ ID NO: 58970 - RNA, 85 nt, Pseudomonas aeruginosa PA01
gagcggagacgaucaugccggcgccaacggugccguuggucaggcgaucgaugacgaugaaggcgccgguggugcgguucugcuc

SEQ ID NO: 58971 - RNA, 55 nt, Pseudomonas aeruginosa PA01
gagcauccggcacaggcgcaggacgaaacgguuggcgucgguggccgaggugguc

SEQ ID NO: 58972 - RNA, 100 nt, Pseudomonas aeruginosa PA01
gagcaggcggccgagccauuugccgaggaacagccaggcgugggugaggggugcgcgcauggaguggguguccuugguggugugcguuggcugugggcuu

SEQ ID NO: 58973 - RNA, 55 nt, Pseudomonas aeruginosa PA01
gagcagggcuuccaggcggucccucgggaccgugcggaagacgccuuccaagcuc

SEQ ID NO: 58974 - RNA, 58 nt, Pseudomonas aeruginosa PA01
gaugccgacgaucagccggagcaucucgucgauguagucggcggggccgucggucauu

SEQ ID NO: 58975 - RNA, 64 nt, Pseudomonas aeruginosa PA01
gaugaucgcgcagcaacaggggccgguccugcuggugggacacuccuauggcggcgcggugauc

SEQ ID NO: 58976 - RNA, 67 nt, Pseudomonas aeruginosa PA01
gaugcagggcaggauggcgaacagcaggccgagacugaucagccaggccgcgcucuugccccacauc

SEQ ID NO: 58977 - RNA, 85 nt, Pseudomonas aeruginosa PA01
gaugccgcugucacgcgccugaccgguggcgcgguagcgcaccaggcggaaggcggcguccuggaucagcgccuggcgcggcauc

SEQ ID NO: 58978 - RNA, 57 nt, Pseudomonas aeruginosa PA01
gaugccggugcuguccaaggcguuuuccaucagcgccgcggaaagcagccuggcauu

SEQ ID NO: 58979 - RNA, 69 nt, Pseudomonas aeruginosa PA01
gauggagcaggugcgcgauggccaacucgucugccgcugacaagcauccccaggcgcgccugcugaauc

SEQ ID NO: 58980 - RNA, 76 nt, Pseudomonas aeruginosa PA01
gauguucgccggcggcaucgccaaggucggcacccggaugggcaccggccuggccauggcgguggacgacagcauc

SEQ ID NO: 58981 - RNA, 57 nt, Pseudomonas aeruginosa PA01
gauggccagggcgauaugaaggccauuggcggcuacaucgucggcgcccuggugauc

SEQ ID NO: 58982 - RNA, 105 nt, Pseudomonas aeruginosa PA01
gauggcggccagccauuucaccgcguucucgucgaagcggccgaacuugcccugggccagguucagcagcgagccgcuggagaaggcggugauggugccggcguc

SEQ ID NO: 58983 - RNA, 57 nt, Pseudomonas aeruginosa PA01
gauggugaccuggcggacgucgaugccccgauccagggcgcgacgcaggucgccauc

SEQ ID NO: 58984 - RNA, 61 nt, Pseudomonas aeruginosa PA01
gcaagcccuggugcagcgcaaggccggugaaagcacggcggugaacuggaugagggugggc

SEQ ID NO: 58985 - RNA, 76 nt, Pseudomonas aeruginosa PA01
gcaaugccuugcccuccaucuguagcaucgccgccaggcuggcaccgggcagcggcguggagugguagggcugggu

SEQ ID NO: 58986 - RNA, 98 nt, Pseudomonas aeruginosa PA01
gcaauggguagagcaugucgucgucgaauagcggcuuuucgaugcgcagguagccuucgccgucgaacagccgcuucgccagcgcguucgccuguugc

SEQ ID NO: 58987 - RNA, 55 nt, Pseudomonas aeruginosa PA01
gcaacccucggccgaaggcuccgaccagcccuggcaggccgaggccgagaguuuc

SEQ ID NO: 58988 - RNA, 84 nt, Pseudomonas aeruginosa PA01
gcaacggacggccuucgccagcggcgcgcuccagcgccucaaccaggccgcgcagggcccgcucgcugggcggcaugacguugc

SEQ ID NO: 58989 - RNA, 128 nt, Pseudomonas aeruginosa PA01
gauucuccgccggcgaccgccaauccagggugcccagugacaggcgcuggcgucgcgcccguugguucgcugccggcagcgccucgccacgcuccagcgcucgggccucgugaucgcuggcgaggauc

SEQ ID NO: 58990 - RNA, 67 nt, Pseudomonas aeruginosa PA01
gcaaagcuggaagaucaccuguucgaucccgccuaccguuucgcucagguaggucuuguagaagugc

SEQ ID NO: 58991 - RNA, 84 nt, Pseudomonas aeruginosa PA01
gcagcccugcagccaugugcgccggggaugaucggcgagcuguacaucggcggccagugccuggcucguggcuaccugggccgc

SEQ ID NO: 58992 - RNA, 81 nt, Pseudomonas aeruginosa PA01
gcaggaacugcagcgggcgcgggucgucguugccgcugcugcuggcgacgaacagcucgagccccuggcugcgggccucgc

SEQ ID NO: 58993 - RNA, 76 nt, Pseudomonas aeruginosa PA01
gcaggccagcggacgcgacgccuugugggcugccgaacagugccugcgcucgggcaguugcgccgcugugcugugc

SEQ ID NO: 58994 - RNA, 112 nt, Pseudomonas aeruginosa PA01
gcaggcccguuggcugucaagcgguccggccgcgccggcaggaaaaagccccugccgcgauggcaggggcuugccguuuuggccgaacaccgccggaggucagcgggucagc

SEQ ID NO: 58995 - RNA, 77 nt, Pseudomonas aeruginosa PA01
gcaggccgaccgccugggccgccugccagcgcugcggauugcgcagcagggcgaggaucgcccgcgaaguggccugc

SEQ ID NO: 58996 - RNA, 59 nt, Pseudomonas aeruginosa PA01
gcaggcgcgccgggcccugcucaacggccagccggcaugcgccacggcgcgcacccugc

SEQ ID NO: 58997 - RNA, 83 nt, Pseudomonas aeruginosa PA01
gcaggcgcuggaugcgggcaucgccacguacgugagccugaaucugucgcuccagucgagcgaugcgcgccuccagcgucugc

SEQ ID NO: 58998 - RNA, 111 nt, Pseudomonas aeruginosa PA01
gcaggcuggucucgcgcgacagcaggcgcuuggcgcggcggaacagguggcgcaccgacucgucggccuuggccacuuccugcuugaccagcggcgcgaucaccagcuugc

SEQ ID NO: 58999 - RNA, 57 nt, Pseudomonas aeruginosa PA01
gcagcaccgcgacggugcccgccucgcccauggcgcgggcgucguccucggucaugu

SEQ ID NO: 59000 - RNA, 65 nt, Pseudomonas aeruginosa PA01
gcagaugguugucggccugggccuggcgcucgcgcgccuccugcaagcgggccugcaauccuugc

SEQ ID NO: 59001 - RNA, 56 nt, Pseudomonas aeruginosa PA01
gcagcgaccuggcgacgcgccugguggaccugcgccagggcgcgcucgggcgcugc

SEQ ID NO: 59002 - RNA, 88 nt, Pseudomonas aeruginosa PA01
gcagcgcacgaucuccacccgcuggcgcucgccgauggacagcccauggaccagccggcgaggcuccagcggcaugccguagcgcugc

SEQ ID NO: 59003 - RNA, 60 nt, Pseudomonas aeruginosa PA01
gcagcgccacccgcggaucgaacugguaacggguggcgaacuugccguugguggugcugc

SEQ ID NO: 59004 - RNA, 61 nt, Pseudomonas aeruginosa PA01
gcagcgcgcggacuaccggguggccggcuacggcgcgccgcaggugguggccgcgccgcgc

SEQ ID NO: 59005 - RNA, 66 nt, Pseudomonas aeruginosa PA01
gcagcucgaccaggccgggcaggagguagucgccccccagguccucggccccggccaggugacugc

SEQ ID NO: 59006 - RNA, 81 nt, Pseudomonas aeruginosa PA01
gcagccacaccagcagcucgccgagacggccguccugggcacuguccggcagcggcugcucgaugaacugggccuggccgc

SEQ ID NO: 59007 - RNA, 90 nt, Pseudomonas aeruginosa PA01
gcagccacuggcugacgguggugccggugagcuggcggaaaugccgggugaagguccgccggcucaucagcacccgcugugccaggcugu

SEQ ID NO: 59008 - RNA, 69 nt, Pseudomonas aeruginosa PA01
gcagaggcuguugaccacccucgaagcccggagcgaccuugccaccggagcgggaggucagaccuuugu

SEQ ID NO: 59009 - RNA, 72 nt, Pseudomonas aeruginosa PA01
gcaccuccggcggcaucaggcccugcaccgcagugaucgagaggauguagagggccgccgcggccagcgugc

SEQ ID NO: 59010 - RNA, 59 nt, Pseudomonas aeruginosa PA01
gcaccugaaggccuccggcaacggccacguggucaaugucuccagcgucuucgggcugu

SEQ ID NO: 59011 - RNA, 86 nt, Pseudomonas aeruginosa PA01
gcaccugcugcgcgaggaacuggccggcgaggagcagcgcaagaccaucaccuccuucuccggcaucuucagcaauccgcaggugu

SEQ ID NO: 59012 - RNA, 71 nt, Pseudomonas aeruginosa PA01
gcaccgcgucgcgaucgcccaggcccugccggaagcgaucgacaauggccagggcgaccgcgagcgggugc

SEQ ID NO: 59013 - RNA, 68 nt, Pseudomonas aeruginosa PA01
gcaccagcggcggcgcgguggauucgcgcaggaccagcgccggcgccaccacccgccgcugcaucggc

SEQ ID NO: 59014 - RNA, 97 nt, Pseudomonas aeruginosa PA01
cggcucggcuucggcgggcgccgcggcgcucggcagauggcgcgcgaucaguacacgauagccgccggcgccgaggcaggcaccgaggaucggggcg

SEQ ID NO: 59015 - RNA, 89 nt, Pseudomonas aeruginosa PA01
cggcguucgcccggcucgcugccagcgccaggggauccaggucgcaagccaccaccucgcggcgccggcgcgggccgcggcgaucgccg

SEQ ID NO: 59016 - RNA, 77 nt, Pseudomonas aeruginosa PA01
cggcguugccgccuuccagcucggagagucggcgcucaucggcguccgggguuuccugcuggcggcggcucucgccg

SEQ ID NO: 59017 - RNA, 63 nt, Pseudomonas aeruginosa PA01
cgggcagcaccucgccagccggaccgacgagacaguguucgcgcggauggcgggugcgcaccg

SEQ ID NO: 59018 - RNA, 115 nt, Pseudomonas aeruginosa PA01
cggcugcagguagcugagggucaggcuguacuugucguagcgcgcauucggaucgcccgccugcggguggccgcgacccugcgcgccaagggcgccgaugcccugcugccagccg

SEQ ID NO: 59019 - RNA, 78 nt, Pseudomonas aeruginosa PA01
cgggcuacccggccugccuugccgucggaaguaagccggggucgcgacgauggccaagcgcagguccgggccgacccg

SEQ ID NO: 59020 - RNA, 79 nt, Pseudomonas aeruginosa PA01
cggggaaccgucgaggcgggcaacgccgccgacgaucgccgggucgucggcgaaaugccggucgccgugcaguuccucg

SEQ ID NO: 59021 - RNA, 78 nt, Pseudomonas aeruginosa PA01
cggggcgucccgaccugccgcugcgggugcagccggacacccgguccacgcgcuuccggcacuuccacgcgcgccucg

SEQ ID NO: 59022 - RNA, 61 nt, Pseudomonas aeruginosa PA01
cggggagccucgucgacgaggcccgccaugggccaagguuuguugucgggaggcucucccg

SEQ ID NO: 59023 - RNA, 61 nt, Pseudomonas aeruginosa PA01
cgggaagcgcgccugcugcuugagcucgaacugcgccucgagcagcgcuucgcgcaacucg

SEQ ID NO: 59024 - RNA, 66 nt, Pseudomonas aeruginosa PA01
cgggccuuccagggcgcccucggcuacgcccgcgaacgccugcagucgcgcgcccuggucggcccg

SEQ ID NO: 59025 - RNA, 100 nt, Pseudomonas aeruginosa PA01
cgggcgccggacggcagcaccagcgggccgggcuucagcaucgacgcgaccaccaacgugauccaguucaguccggccacuggcaauccgccgacucccg

SEQ ID NO: 59026 - RNA, 63 nt, Pseudomonas aeruginosa PA01
cgggcgccgggugcucccggucgccgcugacagcgcgaguuauaggccagcgcccgguguccg

SEQ ID NO: 59027 - RNA, 57 nt, Pseudomonas aeruginosa PA01
cggucgcgccaugacccuggaggccaacgaaggcuucguccgcgugguggcgcgucg

SEQ ID NO: 59028 - RNA, 59 nt, Pseudomonas aeruginosa PA01
cggucgaggagcagcccggcacugcgcaacugggccagguggcggcugaucuucggcug

SEQ ID NO: 59029 - RNA, 61 nt, Pseudomonas aeruginosa PA01
cggucucuccgcugcugcugggcuggcagcaacgcuggcggcaguuccggcggauggucug

SEQ ID NO: 59030 - RNA, 61 nt, Pseudomonas aeruginosa PA01
cggugagcugcgcgaaggcgauacgcuggugcuuggcaucggcgugcgcgcuggcuggcug

SEQ ID NO: 59031 - RNA, 116 nt, Pseudomonas aeruginosa PA01
cggugaucgaccagcacggccgcaccgcguuguucaccggccgcgaggcgcuuggcguccaccaugcgcgggccggcgaacaaugcguggcggccggcaaccugcuggccgcgccg

SEQ ID NO: 59032 - RNA, 85 nt, Pseudomonas aeruginosa PA01
cgguggcgauccucaccgcggcgaugcgcuucgccggccagggcggccaggccggcaccgaugucaccgcggugcagagcacccg

SEQ ID NO: 59033 - RNA, 113 nt, Pseudomonas aeruginosa PA01
cgguggacaucuuguccggcaccaccagcaccacccgguagcccuucgcgcggccgaccagggccaggccgagaccgguguugccggcgguggccucgacgauggugccaccg

SEQ ID NO: 59034 - RNA, 68 nt, Pseudomonas aeruginosa PA01
cgguggacggcaucgcgaccuuccgcguggacaucgauguguccaccugcggagugaucuccccgcug

SEQ ID NO: 59035 - RNA, 63 nt, Pseudomonas aeruginosa PA01
cggguugugcuggagcugcuguccgaccacacagaauuguucaagcaguucagcgacaacccg

SEQ ID NO: 59036 - RNA, 71 nt, Pseudomonas aeruginosa PA01
cggguggcgcaggccugccggaugaucgagacggcggagacgccgccggcacuggaggcgcuggccgcccg

SEQ ID NO: 59037 - RNA, 67 nt, Pseudomonas aeruginosa PA01
cgguagcccuuguggucacugccuggagcggccgcggccugcccacggcgcugccacagaagcacug

SEQ ID NO: 59038 - RNA, 69 nt, Pseudomonas aeruginosa PA01
cgguccaccacggcgaccacguugggguucucgccaagggcgcggaugcugauggugccguccuggccg

SEQ ID NO: 59039 - RNA, 66 nt, Pseudomonas aeruginosa PA01
cggucccgacggccagaaaggcgccgaccuggcuccggccagcgccgagcugaagcuguaggaucg

SEQ ID NO: 59040 - RNA, 73 nt, Pseudomonas aeruginosa PA01
cgggguguccuggcgggugcugcuggaggaccugcaacaggucuaccgucaguucgccgagggcgccgaaccg

SEQ ID NO: 59041 - RNA, 76 nt, Pseudomonas aeruginosa PA01
cgggucgcccggcuguucgucgccggcggugugcgcaagcugcgccugaccggcggcgagccgcuggugcggcccg

SEQ ID NO: 59042 - RNA, 102 nt, Pseudomonas aeruginosa PA01
cgggugaagccuucguucacgucgaucagcgugccgucuucgaggcugcugaucagcagaccgucgggguaggcauggaaggcguuggcgaacuucuccucg

SEQ ID NO: 59043 - RNA, 62 nt, Pseudomonas aeruginosa PA01
cggcgacgcgcuguucagccugcgcugcgauugcgguuuccagcuggaaggcgcgcuugccg

SEQ ID NO: 59044 - RNA, 62 nt, Pseudomonas aeruginosa PA01
cggcgaaaacaccagccuuucaggaauauuuuucaugcccgcaaggcauggguuuuucgucg

SEQ ID NO: 59045 - RNA, 62 nt, Pseudomonas aeruginosa PA01
cggccuugagcaggacgucggucuggcgcaguugcgccgggaggaagucauugcccgggccg

SEQ ID NO: 59046 - RNA, 130 nt, Pseudomonas aeruginosa PA01
cggccuggacuucugcgcgaucgcccgcggcuauggcgucgaggcgcuccacgcagccacccgcgaagagcuggaaggugccuugaagcaugcccuggccgcugaucgcccgguuuugaucgaggugccg

SEQ ID NO: 59047 - RNA, 82 nt, Pseudomonas aeruginosa PA01
cggccuggauuugucguucuggguugcacgcgggcgggccaggggccgcgccggugucagcgggccaggggcggucgggccg

SEQ ID NO: 59048 - RNA, 63 nt, Pseudomonas aeruginosa PA01
cggcggcagguuuucucgacgccgcaagcgaacgcccaccggcgaagaacaauuugcgcgccg

SEQ ID NO: 59049 - RNA, 64 nt, Pseudomonas aeruginosa PA01
cggcggcggccagccaggcccgcaccaggccgcgccgguggacuggcacuggcuggcccugcug

SEQ ID NO: 59050 - RNA, 71 nt, Pseudomonas aeruginosa PA01
cggcggcggcgagccggcgcucggccgcgcggacguccgggcggcgcgccagcaggcuccagccgucgccg

SEQ ID NO: 59051 - RNA, 109 nt, Pseudomonas aeruginosa PA01
cggcggcggugaccugggcgaucaugaagccggaguugaccccgccguuggccaccaggaacggcggcaacugcgacaugugcauguccaucaucagcgagaugcgccg

SEQ ID NO: 59052 - RNA, 71 nt, Pseudomonas aeruginosa PA01
cggcguagcccugguucgugcccugcaagccaucgaaggccugaagggugacaacgaggagcagaacgucg

SEQ ID NO: 59053 - RNA, 95 nt, Pseudomonas aeruginosa PA01
cggcguaguccggggcguugaagauggccgagccggcgacgaagguaucggcgcccgccgcggcgaucucacggauguucuugacguugacgccg

SEQ ID NO: 59054 - RNA, 67 nt, Pseudomonas aeruginosa PA01
cggcguggccggcgcgauggcguccacgguggugcugcccuggccgccgguauugccggccgggucg

SEQ ID NO: 59055 - RNA, 64 nt, Pseudomonas aeruginosa PA01
cggcgccaucggcucgcugcgcggcccgcugcacggcggcgccaacgaggcggcgauggaacug

SEQ ID NO: 59056 - RNA, 64 nt, Pseudomonas aeruginosa PA01
cggcgccgacaucgcgcagguccaacucgacggcaagccgcuggccgaccugcugauggcgccg

SEQ ID NO: 59057 - RNA, 80 nt, Pseudomonas aeruginosa PA01
cggcgcgcuggugcaauggcuguugcgcgaagucccggcgcucugaugcgccugcgcaacuggccgcgcuggcagcgcug

SEQ ID NO: 59058 - RNA, 62 nt, Pseudomonas aeruginosa PA01
cggcccgcgcagcgaccugccgcaacugcaccugugcggcugcgaacgguccugcgccgccg

SEQ ID NO: 59059 - RNA, 89 nt, Pseudomonas aeruginosa PA01
cggccagccgcugagcccgcagcgccggcgccugcucgccgcccucggccagccucuggcccaggcccuggcgcgggcucgccuggccg

SEQ ID NO: 59060 - RNA, 62 nt, Pseudomonas aeruginosa PA01
cggccagcggcuggcugacgaugaccacggucaucagcgcccacuucggcugcuccaggucg

SEQ ID NO: 59061 - RNA, 62 nt, Pseudomonas aeruginosa PA01
cggcagggccuugcgggaccggggaggaaccgcucugcggcuggguuccgucggccuugccg

SEQ ID NO: 59062 - RNA, 102 nt, Pseudomonas aeruginosa PA01
cggcaguuguauggaaaggaaacgcguccggcgcgaggcccggcguucggcuagaggcagccgaggccagggcggcggcgucaggauccggagcaauagucg

SEQ ID NO: 59063 - RNA, 82 nt, Pseudomonas aeruginosa PA01
cggcauucccggcucggcccuggugauccucgccgccacccucaccgcggugccggcgaucccgguggccggccuggugcug

SEQ ID NO: 59064 - RNA, 126 nt, Pseudomonas aeruginosa PA01
cggauguucucgccgccggccaggcgcucggcgaacagcgugccggugcgucguucgugggcgauguagucgaugcgcuggcgcaccagcuugccgaaguucugucggcugucggaaacccauucg

SEQ ID NO: 59065 - RNA, 129 nt, Pseudomonas aeruginosa PA01
cggaagcccccuccagcaaguagccgaaggucggcuucgaguggaccagcgguagcgcggucgccgccaacgcgccccacuggcgccgcucgaaggcgccgaagggcuggcugaaaucgaggaugcccg

SEQ ID NO: 59066 - RNA, 71 nt, Pseudomonas aeruginosa PA01
cggcacuuacagcgucgacauucauuugaaccagaucaugauccggcgcgaagaugucguguucagugccg

SEQ ID NO: 59067 - RNA, 56 nt, Pseudomonas aeruginosa PA01
cggcagcagcgccggcgaggagggcuaccguauccgcguccuggcgcucgaugccg

SEQ ID NO: 59068 - RNA, 130 nt, Pseudomonas aeruginosa PA01
cggcagcaugcugaugaccacgucggcgcccugcaccgcgucgcgggcgcugcgggcggcgcuggcgccggcggcgaccaggccgucgacggcgcucugcaccaggucgaagacguucagcagguagccg

SEQ ID NO: 59069 - RNA, 81 nt, Pseudomonas aeruginosa PA01
cggcagcgagcugcaacugggccuggucgccgcggaccggggucucggccuggugccggcgccggcccuggcgcguagccg

SEQ ID NO: 59070 - RNA, 83 nt, Pseudomonas aeruginosa PA01
cggcagcggcggcaauacgucgcucagucaacuggccuucgaucccgcgacggcucccaagcucagcgacggcgccgcugccg

SEQ ID NO: 59071 - RNA, 82 nt, Pseudomonas aeruginosa PA01
cgccaccggcgcgccggcagccugcugcgcgccuaugucuggccgcugggcgcguacaucggugucggcgcggugcuuggcg

SEQ ID NO: 59072 - RNA, 59 nt, Pseudomonas aeruginosa PA01
cgcaggcugccggcggcuaccugguggaacagcggcaggaagcuuuccggcaguucgcg

SEQ ID NO: 59073 - RNA, 76 nt, Pseudomonas aeruginosa PA01
cgcagggcacgccggcgaggcugcggcgcucgcggacgacgccgccggcgcccagcgucgccaggcucagcccgcg

SEQ ID NO: 59074 - RNA, 112 nt, Pseudomonas aeruginosa PA01
cgcauccaccaucaugucaccgcccuggccuauccgcugcucgaacgcagcggcaucgauccgauggcgaagcggccggaugagccagggcaaggggagggaucggcaugcg

SEQ ID NO: 59075 - RNA, 58 nt, Pseudomonas aeruginosa PA01
cgcauggcgaaggcccucucggagugacgacugaaacacucaggccuggagccgagcg

SEQ ID NO: 59076 - RNA, 70 nt, Pseudomonas aeruginosa PA01
cgccagcaggcggcgguccagcucgcacaggcggcgacgcccggcgagacuggcgcugccgccggcggcg

SEQ ID NO: 59077 - RNA, 65 nt, Pseudomonas aeruginosa PA01
cgccagccugcucgcuggcgagcgcggcgaacaggcggcguuguugcuggacgagcggcuggacg

SEQ ID NO: 59078 - RNA, 94 nt, Pseudomonas aeruginosa PA01
cgccagcgccggcagcucggcaagggcgccgcgggucaccugcuggcccgccugggugcccuggcugaccagcgccgccggggugucgcuggcg

SEQ ID NO: 59079 - RNA, 59 nt, Pseudomonas aeruginosa PA01
cgccaggccggcuuucagcgcggccagggccgccugguaguagcugcggccggccggcg

SEQ ID NO: 59080 - RNA, 94 nt, Pseudomonas aeruginosa PA01
cgccaggcgcuugcgcacgaugcugucgguggucgggcucggcgugccgcgcuggccgaguuccgccgacagggucggcaacgggcagccggcg

SEQ ID NO: 59081 - RNA, 113 nt, Pseudomonas aeruginosa PA01
cgccgacugcggcaggucgacaccgcgcggcaggugcgccaucggugccucggccggcaggccggcggccaguuggcgggccaccguggcgcugaaggccugcagggucggcg

SEQ ID NO: 59082 - RNA, 84 nt, Pseudomonas aeruginosa PA01
cgccgcaaucacggucuugaguugacuggccaugucggcagcacugacgaaggccgggucgauacgcaggcugugacguccacg

SEQ ID NO: 59083 - RNA, 65 nt, Pseudomonas aeruginosa PA01
cgccgcagcuggcccggcaaaccuucgucgacacccucgggugcgauccgggcuggcugcaggug

SEQ ID NO: 59084 - RNA, 92 nt, Pseudomonas aeruginosa PA01
cgccgcagggcuaucgaaucggcgucacggugcauggcgaucgccugccggcgccaccgcagagugccgaaugcucgcuggccuaccuggug

SEQ ID NO: 59085 - RNA, 72 nt, Pseudomonas aeruginosa PA01
cgccgccagcaguucgcgggcacgggccaccgccaacggcuccugcccggccuucggcgcuucuggcaggcg

SEQ ID NO: 59086 - RNA, 76 nt, Pseudomonas aeruginosa PA01
cgccgccaggcugcggucgccggcggcgcgccggcugggccgauagccggcggccucggcggccucggcaguggcg

SEQ ID NO: 59087 - RNA, 92 nt, Pseudomonas aeruginosa PA01
cgccgccccgguguccuccucggcgcugguggccgaaggcgugaaggucuucgucgauccccagggccgcggagcgcaggccggcggcggcg

SEQ ID NO: 59088 - RNA, 83 nt, Pseudomonas aeruginosa PA01
cgccgccccugcgcuggcguucgacgagcuggagcggcgcacuggcggccugccguugaagucggcgcccugggggaaggacg

SEQ ID NO: 59089 - RNA, 74 nt, Pseudomonas aeruginosa PA01
cgcccucucccaccugcugggucgccgcguauucaugcuccgggaaauccggcaggucguugggauuggaggcg

SEQ ID NO: 59090 - RNA, 72 nt, Pseudomonas aeruginosa PA01
cgcccugcugccccggcgcggcugagcaugccggcccacgcggucagccuggcgccgggcgcggcggcagcg

SEQ ID NO: 59091 - RNA, 130 nt, Pseudomonas aeruginosa PA01
cgcccuggccguuguccagcuucccggcgaugcucagggucacgucgcuuucgccggagacaaugcccugggcguuauccaggcuggcggcgucgauccguugcgcgcccuugcugaccagcgcgcccug

SEQ ID NO: 59092 - RNA, 130 nt, Pseudomonas aeruginosa PA01
cgcccuggccguuguccagcuucccggcgaugcucagggucacgucgcuuucgccggagacgaugcccugggcguuauccaggcuggcggcgucgauccguugcgcgcccuugcugaccagcgcgcccug

SEQ ID NO: 59093 - RNA, 61 nt, Pseudomonas aeruginosa PA01
cgcccuggugcugaucgucggugccgcccugcugcucuggagccgaccggcggcccaggcg

SEQ ID NO: 59094 - RNA, 129 nt, Pseudomonas aeruginosa PA01
cgcaccugcaccauggcguggucgcccggggcaaccugagcgucggcggcgcggucaaggccgaggucgacgccucgguacgccaggccaccgcgcucaaccacuccgcgacccaccugcugcaugccg

SEQ ID NO: 59095 - RNA, 61 nt, Pseudomonas aeruginosa PA01
cgcagccaacggccgaggaacuggccgcccuggaagaggcugcccggccgcuguggcugcg

SEQ ID NO: 59096 - RNA, 77 nt, Pseudomonas aeruginosa PA01
cgcagcgagguuucgccagccauggucgguccgcgucggguggaucggaaaagugcuggcgaguguggccgcgggcg

SEQ ID NO: 59097 - RNA, 98 nt, Pseudomonas aeruginosa PA01
cgcagcgcuccccgguggccuugagcagguaagcggcaucggcuaccucguagucggugugccggcgcggcguaccguucgccugggauucgcguucg

SEQ ID NO: 59098 - RNA, 87 nt, Pseudomonas aeruginosa PA01
cgcaggacgaagcgguuggcgucgguagcgguggucgcuaccugccagaacggcaggccgaagcgcugcgccagcaacucgccugcg

SEQ ID NO: 59099 - RNA, 130 nt, Pseudomonas aeruginosa PA01
cgauguugagcaguucgauuucuccgccgcgaauccgcagcaggcucaggcaggccgccggcaugucuucgaggucgugccagucgcggccgcucugggcgcggaagucgcccuggauaucguugagcag

SEQ ID NO: 59100 - RNA, 56 nt, Pseudomonas aeruginosa PA01
cgaugcgggcgccacucucgaucaccgcauaggcgccgacgcuggcgcucggaucg

SEQ ID NO: 59101 - RNA, 76 nt, Pseudomonas aeruginosa PA01
cgagucggcgauggccagcagcgcggcgaucacuuccgcgucauucuugccgcgcaggucggcgaucccguacucg

SEQ ID NO: 59102 - RNA, 55 nt, Pseudomonas aeruginosa PA01
cgaggccggcguggcgaaguaggcgaccagcggcaguucgucauccaccgccucg

SEQ ID NO: 59103 - RNA, 59 nt, Pseudomonas aeruginosa PA01
cgaggcggccgaggaaauagcccuggcgauugccggcgcggacuuccuggaucgccucg

SEQ ID NO: 59104 - RNA, 128 nt, Pseudomonas aeruginosa PA01
cgagggcgcuauccagucguuccaggucggcgcagaggaucaccccggcgucgcgcaucucgucgcaggcccgcugcgcgguguccucggcgauggcccggcaggcgggcagguagagcagcaccucg

SEQ ID NO: 59105 - RNA, 120 nt, Pseudomonas aeruginosa PA01
cgaucuccugcucguggccgaggaucgcgcgcaagcgcucgccggcuuccugccaggucagccgcuggaagcccaggcgugcguagaacggcgcguuccagggcacgucgcagaaggucg

SEQ ID NO: 59106 - RNA, 57 nt, Pseudomonas aeruginosa PA01
cgaucgccccgcgcagguugaucacgcccuugaugaagggcggcgcguuggcgaucg

SEQ ID NO: 59107 - RNA, 78 nt, Pseudomonas aeruginosa PA01
cgauccgcggccugggcaagcucggcaagggcauccaggaagccaaguucgucggcgugcccggcgcccccggggucg

SEQ ID NO: 59108 - RNA, 57 nt, Pseudomonas aeruginosa PA01
cgcuuccggcgaagcuccagcgacucguucgagaucgggcugcgaucggcggaagcg

SEQ ID NO: 59109 - RNA, 96 nt, Pseudomonas aeruginosa PA01
cgcuucggcagcgacaagcgccuggcgcgccuggcugauggcacgacccugcuggcggccagcguggcgcgggcgcgcgaggcguucgccgaggug

SEQ ID NO: 59110 - RNA, 63 nt, Pseudomonas aeruginosa PA01
cgcuggucggccugcuccgcgcgcgcgacgaggcgcaugcgcuggaguuggccaacgccagcg

SEQ ID NO: 59111 - RNA, 67 nt, Pseudomonas aeruginosa PA01
cgcuggaggcgccgcgcuggaagcugaaguuggacaggcaaugcaguucggcguaggcgcucaugcg

SEQ ID NO: 59112 - RNA, 80 nt, Pseudomonas aeruginosa PA01
cgcugcgggaggacccggacaucauccuggucggcgagaugcgcgaccuggaaaccauccgccuggcccugaccgcggcg

SEQ ID NO: 59113 - RNA, 102 nt, Pseudomonas aeruginosa PA01
cgcucugcaggucgagguugccggcccggcuguccaggcggccggccugguuguccagcgcgccaccgauacgcagccgguugucgcccugggccuggagcg

SEQ ID NO: 59114 - RNA, 71 nt, Pseudomonas aeruginosa PA01
cgcggcugccggcgcggcgguugaggccuucgagguaggcguugaccugguugcgccgguauggcgucggg

SEQ ID NO: 59115 - RNA, 96 nt, Pseudomonas aeruginosa PA01
cgcggugacugccugucgcucgccggccuggcccgcgaagucagcgccaucuacgacguuccgcuggcgccgguggcgguggacgcggucgccgcg

SEQ ID NO: 59116 - RNA, 65 nt, Pseudomonas aeruginosa PA01
cgcggugcagcugcucgguggccacggcuucaccaaggagcauccggccgagcgcugguaccgcg

SEQ ID NO: 59117 - RNA, 71 nt, Pseudomonas aeruginosa PA01
cgcggcgacccgccaggcgcugggcgagucgcucugcgaggugcucgccggagcgguggcgggcggcggcg

SEQ ID NO: 59118 - RNA, 130 nt, Pseudomonas aeruginosa PA01
cgcuaucuuugcgaccuggaaaaaaucgcgcgagccuggcuccgccuucuugucguuguggucugucgaaucccgcgcgggcaguggcggacaggccgccucaggcgauugcccaggucgcgagacagcg

SEQ ID NO: 59119 - RNA, 79 nt, Pseudomonas aeruginosa PA01
cgcucgaucggccugggccuggaagacguagcccuggccaacgcccucuaccgccugcgccaggcaggcugaucgcgug

SEQ ID NO: 59120 - RNA, 66 nt, Pseudomonas aeruginosa PA01
cgcucggccagggcaaugucgaagccgaccgagagcgccuuggccuugucgucguccuggcuggcg

SEQ ID NO: 59121 - RNA, 88 nt, Pseudomonas aeruginosa PA01
cgccgggcccaccgucacgccgagggcuaucauucccgcgccgcgcgccaccagcggcccggcauggaccccggcgucgggcuuggcg

SEQ ID NO: 59122 - RNA, 62 nt, Pseudomonas aeruginosa PA01
cgccguagcgaccgguguagcgccggcugcuguucugcacgucggcgcggaaggucgcggug

SEQ ID NO: 59123 - RNA, 68 nt, Pseudomonas aeruginosa PA01
cgccggcgcuguuguccaggcucccgccugucaccgucaggcccugccauccggagagcaggccggcg

SEQ ID NO: 59124 - RNA, 78 nt, Pseudomonas aeruginosa PA01
cgccugcccggcuucgagcuggcgcuccuggccgcucuggaccagggcgaugucgaccucgccggugccgagcaggcg

SEQ ID NO: 59125 - RNA, 78 nt, Pseudomonas aeruginosa PA01
cgccuggccgagcaggccggggugaccaagccgguggucuaugaccacuucggcacccgcgccggccugcuggcggcg

SEQ ID NO: 59126 - RNA, 58 nt, Pseudomonas aeruginosa PA01
cgccugggcgaacucgccccgccgaccagccgcgcccugcacugaggccgcucaggcg

SEQ ID NO: 59127 - RNA, 76 nt, Pseudomonas aeruginosa PA01
cgccggccagguggagcguugcggcgccggcgggguuuccaguuggcggccgucgcgcaccaccaguucgccgccg

SEQ ID NO: 59128 - RNA, 71 nt, Pseudomonas aeruginosa PA01
cgccgccgcgcaggcgguacaggcggcugucgccggcccacaggcagcucgccugguugccgcgcgcggcg

SEQ ID NO: 59129 - RNA, 130 nt, Pseudomonas aeruginosa PA01
cgccggacgggguaccggugcgcuggcggauagcgccagggcgcuauucgcccuacggguuacgaggagcucggguagggcgaauagccgcucgcggcuauccgccgggcgggguaccggugcgcuggcg

SEQ ID NO: 59130 - RNA, 72 nt, Pseudomonas aeruginosa PA01
cgccggcaccugcacgcccaguuguuucugcgccucgaacagcgagcgcaggaacagggucagggucggucg

SEQ ID NO: 59131 - RNA, 94 nt, Pseudomonas aeruginosa PA01
cgccggcagaagcucuacggcagccugcggcugcuggugucgaucaaccgcgacggcaccaucuacgaggugcaggugcuggagucuuccggcg

SEQ ID NO: 59132 - RNA, 86 nt, Pseudomonas aeruginosa PA01
cgcgaggccugcgcccggcucuacggcccguuccugcgcggcgaggcacugccggagcgcgccgagggcagcacgcggaucccgcg

SEQ ID NO: 59133 - RNA, 91 nt, Pseudomonas aeruginosa PA01
cgcgccaggcgcccgaucccgcugcucgcgccgaagcgccgggaaugccgcagcaugacggucuguugcgccagcggaugcgccugcgacg

SEQ ID NO: 59134 - RNA, 85 nt, Pseudomonas aeruginosa PA01
cgcgcugauccugcugggcggcugugccgcgguggggcccgacuaugcgccgccgagcgcguccgcaccggccagcuucggcgcg

SEQ ID NO: 59135 - RNA, 74 nt, Pseudomonas aeruginosa PA01
cgcggaacgccuugcgaggugguccugcuggauaucuccaugcccggcgucaauggccucgaggcgauuccgcg

SEQ ID NO: 59136 - RNA, 65 nt, Pseudomonas aeruginosa PA01
cgcggcccugcgaccagagcugggccagggccaugucggcgcuggccuggccggcgcgggcggcg

SEQ ID NO: 59137 - RNA, 72 nt, Pseudomonas aeruginosa PA01
cgcaccggcgccgugaccccgguggcacgccucaagccggugcagguggccggcgucacgguguccaaugcg

SEQ ID NO: 59138 - RNA, 103 nt, Pseudomonas aeruginosa PA01
cgcgccacaccuggcgcuggcccgcgagcaggggcuggacggccugaucagccucggcggcgcccacuccaaccaccugcacgcgcuggccggcgcuggcgcg

SEQ ID NO: 59139 - RNA, 56 nt, Pseudomonas aeruginosa PA01
ccuggagcggcgcaucgcgguggagaacauuuccuacuaugcagcgccguaccggg

SEQ ID NO: 59140 - RNA, 88 nt, Pseudomonas aeruginosa PA01
ccuggccugcgagcgcgaggaaaccucgcuggccggcgagaucgccaccacgguggauuuccucgaggugaucuucgacgaggccggg

SEQ ID NO: 59141 - RNA, 129 nt, Pseudomonas aeruginosa PA01
ccuggcggcgcggaucggccugcuguuccccggccccucggcggccuggcugcaacgcgccgagcgccugcggcggcagcaggcgucggcgggccucggggucaggcgcggguggccugcaucgacggg

SEQ ID NO: 59142 - RNA, 103 nt, Pseudomonas aeruginosa PA01
ccuggcuggcaacaucgaugaccacccggugcgcgcccuucugcgaguaguguucgagcaucugcugcaggcgcccgccgaagucccagguguugcgcucagg

SEQ ID NO: 59143 - RNA, 122 nt, Pseudomonas aeruginosa PA01
ccugggcgcgcugcgccggcagcagcuccugcuggcgcugcaccuccugcucggcgaccugcuuggccuuguucugccggugccagauccaguaggcggcagcgccggccagggcgccgagg

SEQ ID NO: 59144 - RNA, 83 nt, Pseudomonas aeruginosa PA01
ccugguacuggaagcgaucggcgcggcugaucgacugggccaguuccaccgguuggccgguacggucgcgggacagggugagg

SEQ ID NO: 59145 - RNA, 77 nt, Pseudomonas aeruginosa PA01
ccugguccuugaacgccuggcuggcgcgcgggucggugacgucgucccacuccagcagggucuucagcaguuccggg

SEQ ID NO: 59146 - RNA, 62 nt, Pseudomonas aeruginosa PA01
ccugguggaaguggucgaggccccggagcauccgugguucgucgccugccaguuccacccgg

SEQ ID NO: 59147 - RNA, 68 nt, Pseudomonas aeruginosa PA01
ccugguggcgcgccagcagcucggcgagggcgcguuucuucucgucguccaugcucgcgcccaucggg

SEQ ID NO: 59148 - RNA, 77 nt, Pseudomonas aeruginosa PA01
ccugcaacagcuccgccaccuccuccccggugagcaggcgggcgucgcccucgcggcggucggcggcaauguucagg

SEQ ID NO: 59149 - RNA, 77 nt, Pseudomonas aeruginosa PA01
ccuacgagccgccggccgaggcgccggaccaggacuacccguucuggcucgccaccggccgggugcucgaacacugg

SEQ ID NO: 59150 - RNA, 56 nt, Pseudomonas aeruginosa PA01
ccugauguucggcgcauccgccagccugauggcugccgaccugccccggacgaagg

SEQ ID NO: 59151 - RNA, 78 nt, Pseudomonas aeruginosa PA01
ccugcuacgaccaccuggccggcgaacucgcggucgguguguucgcacggaugcuggaugccggcuggaucgagcagg

SEQ ID NO: 59152 - RNA, 62 nt, Pseudomonas aeruginosa PA01
ccugcugcgccauccacggcgcgaccugcugaaacugaacaucgacgccggcggcgugcagg

SEQ ID NO: 59153 - RNA, 63 nt, Pseudomonas aeruginosa PA01
ccugcugcucgaggaaugguuccugcgccgcguccagggccggcauuuccccgagcugcacgg

SEQ ID NO: 59154 - RNA, 77 nt, Pseudomonas aeruginosa PA01
ccugcugcuguccuucgaccccgagcugacccgcggccgcacggcgccggcgcucaagggucgcuacagcguacugg

SEQ ID NO: 59155 - RNA, 95 nt, Pseudomonas aeruginosa PA01
ccugcccaagagccucgaggccuauuaccaggaaaccggccgcgccggccgcgauggccugccggccgacgccuggauggccuacggccugcagg

SEQ ID NO: 59156 - RNA, 74 nt, Pseudomonas aeruginosa PA01
ccugccgguggagcgcgugaccggcuacgguucgcucgacgagcaccugaccgccaugcgcuauuccgacuggg

SEQ ID NO: 59157 - RNA, 67 nt, Pseudomonas aeruginosa PA01
ccugccuacgacgugcgcgagcaccuccaacgcggcgagcugcgcgaggugcugccgcaguggcggg

SEQ ID NO: 59158 - RNA, 69 nt, Pseudomonas aeruginosa PA01
ccuacacccucgacggcgacgacgugcugaugcagaaggcgccggugagcuucgacgugucgguguggg

SEQ ID NO: 59159 - RNA, 63 nt, Pseudomonas aeruginosa PA01
ccguagcgaugcuggucgcgcggagucaccgcaaggaccacugccgggcggccggcgacacgg

SEQ ID NO: 59160 - RNA, 106 nt, Pseudomonas aeruginosa PA01
ccgucgacggaacgaucggcgcgcgccggcaucaagagaguaguaccccgcuguuacucgccgcccggucgaccgccauacacugccgauccguuucguucgaggg

SEQ ID NO: 59161 - RNA, 63 nt, Pseudomonas aeruginosa PA01
ccgugcagcucggggaaaugccggcccuggacgcggcgcaggaaccauuccucgagcagcagg

SEQ ID NO: 59162 - RNA, 57 nt, Pseudomonas aeruginosa PA01
ccgugcgcgugcacguuuccucgcuacugcgcgcccuggaagugaacacgcggacgg

SEQ ID NO: 59163 - RNA, 91 nt, Pseudomonas aeruginosa PA01
ccguggcgccggauagcgccucggccaguucgucguucagugccagcaggcggcgggcauagccgagcagcguaucgccggcgucggucgg

SEQ ID NO: 59164 - RNA, 57 nt, Pseudomonas aeruginosa PA01
ccucgccgcgagcguggcacuccgggaucgcgugaggaaugccgagcuugugguagg

SEQ ID NO: 59165 - RNA, 90 nt, Pseudomonas aeruginosa PA01
ccucggacaagcuguucggcgcacggcgcaugccggccugcgugaucagccugcuggcgcugaccgucugccuggcgcuguucgucccgg

SEQ ID NO: 59166 - RNA, 127 nt, Pseudomonas aeruginosa PA01
ccucgggagccgcuucgcgccagcggcgcagccagcccugggcgucgcucagguagcugucgcgcugccugggcgugcgcagggccuggagcagcgacuggaacagggcauagcgguauucccgcgg

SEQ ID NO: 59167 - RNA, 125 nt, Pseudomonas aeruginosa PA01
ccucguccucgcgaacgaucagguuguacuggcucugcaucgagaugaauugcgccaggccgugguggcgcuggaaggcgagcaucuucaugaagcgccaggccggcaucgacgaggcgccgagg

SEQ ID NO: 59168 - RNA, 78 nt, Pseudomonas aeruginosa PA01
cgaagaugcugcccuccaccgcguagcugaccuugccguccagacgguagccgaccguggugagcaggcgguucuucg

SEQ ID NO: 59169 - RNA, 102 nt, Pseudomonas aeruginosa PA01
cgaacggcaaguaccuggugggcuaccugguucccggcgagacaccgcguuccagcgccgacucgccggccggacugaugguggagcagggcgccugguucg

SEQ ID NO: 59170 - RNA, 66 nt, Pseudomonas aeruginosa PA01
cgaaccacuggcaggccgaggacaucgaccgacgcaucgaacgcaagcucggcccgcuguggcucg

SEQ ID NO: 59171 - RNA, 120 nt, Pseudomonas aeruginosa PA01
cgaccuucugcgacgugcccuggaacgcgccguucuacgcacgccugggcuuccagcggcugaccuggcaggaagccggcgagcgcuugcgcgcgauccucggccacgagcaggagaucg

SEQ ID NO: 59172 - RNA, 77 nt, Pseudomonas aeruginosa PA01
cgagcacgacgccccggugcucuucccgcgcggcgucgagcgccugcaaccgggcccggcgcugggcguggugaucg

SEQ ID NO: 59173 - RNA, 119 nt, Pseudomonas aeruginosa PA01
cgagcagcagccgcgaggcgcccagcccgcaucucaccggcggcgcgguggacgucacccugugcgacgcccagggccgcuggcuggacaugggcagcgccuucgacgaagcugugccg

SEQ ID NO: 59174 - RNA, 58 nt, Pseudomonas aeruginosa PA01
cgagcaggccgagcgcgcccuggccgccugggaggugccgcaugcuugagccucuucg

SEQ ID NO: 59175 - RNA, 64 nt, Pseudomonas aeruginosa PA01
cgagcggccagggccugcaccggacgcucgccgguguaggugacgcgcuuuggccggaugcucg

SEQ ID NO: 59176 - RNA, 57 nt, Pseudomonas aeruginosa PA01
cgagccuugaaaagucgccggcgccgugguggcgccggcucgucucagucgagcuug

SEQ ID NO: 59177 - RNA, 55 nt, Pseudomonas aeruginosa PA01
cgaggaacaugccgaugaucaucacuccgucgauccgguccagcggcgugccuug

SEQ ID NO: 59178 - RNA, 83 nt, Pseudomonas aeruginosa PA01
cgaggagccgggagcggaccgccugcucggccuguuccugaacacccugccgugccggcugucggcuuccgucgaucugcucg

SEQ ID NO: 59179 - RNA, 59 nt, Pseudomonas aeruginosa PA01
cgaggaggacgcucgcggucgccugacccugaauuucgacuacgccgcggaccucuucg

SEQ ID NO: 59180 - RNA, 75 nt, Pseudomonas aeruginosa PA01
cgaccgaugccggccugcucuggcgccuguaccgcgaacgggugccggcgauccucggcaaggccgguucggucg

SEQ ID NO: 59181 - RNA, 74 nt, Pseudomonas aeruginosa PA01
cgaccgcugguggguggcgagcaagaaccugcugcucuucggcggcucguucaucgccaucugccuggugcucg

SEQ ID NO: 59182 - RNA, 74 nt, Pseudomonas aeruginosa PA01
cgaaggcgauggucgccaccaugaucaagccuuccucguugaggaagcgcuucugguggugggcacgcaguucg

SEQ ID NO: 59183 - RNA, 90 nt, Pseudomonas aeruginosa PA01
cgaagguggccccgguguccaucgccaucgcccugcugaugcucggcggcggccucugguauggcaagcaccugaagaucggcgaccucg

SEQ ID NO: 59184 - RNA, 65 nt, Pseudomonas aeruginosa PA01
cgaccaggccgggcaacugcgcgacauggugcagaaccaccugcugcaacugcucugccugaucg

SEQ ID NO: 59185 - RNA, 71 nt, Pseudomonas aeruginosa PA01
cgaccaggccguguucgccguggccggggugggcgaaggccagcgccggagcggcgagcagggcgagggcg

SEQ ID NO: 59186 - RNA, 62 nt, Pseudomonas aeruginosa PA01
cgaccagggcuucaccaucggcggggcgcgccagcgccucuccggcgacgaggccaaggacg

SEQ ID NO: 59187 - RNA, 62 nt, Pseudomonas aeruginosa PA01
cgacgaucuggucguucucgcccucgcugaggaaggcgccacgguuaucgcccaguucgucg

SEQ ID NO: 59188 - RNA, 59 nt, Pseudomonas aeruginosa PA01
cgagagcuucgccaaccugauggacuacgguuucaccgccgggauggaggagcaucucg

SEQ ID NO: 59189 - RNA, 84 nt, Pseudomonas aeruginosa PA01
ccgccauggucgaggaccaggcguacguauagcagggcgauggugaacgucuugccgguaccggcgcuggccucgaucaggcgg

SEQ ID NO: 59190 - RNA, 111 nt, Pseudomonas aeruginosa PA01
ccgcccagcgacaugccgaggaaggucgagccgugguaggcguugauccgcgugaugacgugcuucuuggcgcgcuugccgcggcaguucugguaguagugcaugaggcgg

SEQ ID NO: 59191 - RNA, 57 nt, Pseudomonas aeruginosa PA01
ccgccccgccuccugggaccagccccggagggcuguccgagaugauagacggcgcgg

SEQ ID NO: 59192 - RNA, 86 nt, Pseudomonas aeruginosa PA01
ccgccgcgccgcgcaggcccggcuggcgcucggccuggcgcaugaucgccagcucgaccucggccggcucgaugcggaagccgcgg

SEQ ID NO: 59193 - RNA, 68 nt, Pseudomonas aeruginosa PA01
ccgccguguagcgagccgaugguuucauagcgaaugccuuugagcgcgugguucagcagcacauacgg

SEQ ID NO: 59194 - RNA, 65 nt, Pseudomonas aeruginosa PA01
ccgcacggcgaaggcgcacgcuggcaguccuaccuggaagcgcuggacgccuucuuccugcgcgg

SEQ ID NO: 59195 - RNA, 58 nt, Pseudomonas aeruginosa PA01
ccgcagaggucccucggcgcuuuuggcaacaagggcgaagaugccgccuucaucgcgg

SEQ ID NO: 59196 - RNA, 63 nt, Pseudomonas aeruginosa PA01
ccgcagccacagcggccgggcagccucuuccagggcggccaguuccucggccguuggcugcgg

SEQ ID NO: 59197 - RNA, 63 nt, Pseudomonas aeruginosa PA01
ccgauccgccgggugcacagcgaggguuucgugcguuuccugcagaacgccuggcaggacugg

SEQ ID NO: 59198 - RNA, 74 nt, Pseudomonas aeruginosa PA01
ccgaucgaggcgggucgccgaugugcuucggcgucgacgaugcggcagguggcgaagaccguggccucggucgg

SEQ ID NO: 59199 - RNA, 70 nt, Pseudomonas aeruginosa PA01
ccgaucggucucuggugaucagcggcuggccuugcgauaggcccccggcugcuguccgguggccuugugg

SEQ ID NO: 59200 - RNA, 82 nt, Pseudomonas aeruginosa PA01
ccgaugggcuucuccuggcugaccaggggcgagaagcccugcagcgggcucgccggguuggucagccaggcgcugucguugg

SEQ ID NO: 59201 - RNA, 61 nt, Pseudomonas aeruginosa PA01
ccgaggaacgcuccuggcaacugcgcuacgacuucgaccugcgcagcgucggcgugcccgg

SEQ ID NO: 59202 - RNA, 114 nt, Pseudomonas aeruginosa PA01
ccgaccccaggacaccgcgacccauggccgguugggcggcaagccugcgcgacaguggacugcuggcgcuggcagugccgcgcguguucgccggcauggagcgggacugggggg

SEQ ID NO: 59203 - RNA, 130 nt, Pseudomonas aeruginosa PA01
cccuuccagcggcugguugguguccagggucaggcgccgguagcgguccgugcccagcccggcgcccaggugggugaaggcuucggccuugggcugcuugcugaccauguugaugcugccgccgcuggug

SEQ ID NO: 59204 - RNA, 55 nt, Pseudomonas aeruginosa PA01
cccgguggcgauccccgcggugugcuucaccgauccggaagugguggucgccggg

SEQ ID NO: 59205 - RNA, 65 nt, Pseudomonas aeruginosa PA01
cccggccgccaccgucgagcaggcgcgcgaacgccugcaggaaaaguucgauuggcugcgccggg

SEQ ID NO: 59206 - RNA, 78 nt, Pseudomonas aeruginosa PA01
cccggcgcuucuucgccacccuggugcaggagguggucggccugcaccagcgccugcgcgaggaaaccgagcgcuggg

SEQ ID NO: 59207 - RNA, 55 nt, Pseudomonas aeruginosa PA01
cccggcgggcaccuguguggccgggaaacguuugccgcgccuggaccgcgccggg

SEQ ID NO: 59208 - RNA, 67 nt, Pseudomonas aeruginosa PA01
cccgccgagagcgccgagcaggaaugcgauagccagggucugccguaccgcgccgggcuccagcggg

SEQ ID NO: 59209 - RNA, 66 nt, Pseudomonas aeruginosa PA01
cccgcacagccguaucggccugcgccuccagcagcgccucggccauccggcuguacaucgcgcggg

SEQ ID NO: 59210 - RNA, 58 nt, Pseudomonas aeruginosa PA01
cccgagcugcucgaacuccacggucucgacgugccggccuggcgcgagaagcaucggg

SEQ ID NO: 59211 - RNA, 61 nt, Pseudomonas aeruginosa PA01
cccgauagccggcguccgccagggacuccgccaggucuuuccagguaugcgggcuguccgg

SEQ ID NO: 59212 - RNA, 67 nt, Pseudomonas aeruginosa PA01
cccucggccgcgccuuuggcauggcccgccugcgcgggcgcggcacggugcccggcgaugccgaggg

SEQ ID NO: 59213 - RNA, 94 nt, Pseudomonas aeruginosa PA01
cccugccgaccgccugggucggcgcgcugacccgcugggugccgcgcaucgagcgggcgccucggcgugcccugagcccucugguggugcaggg

SEQ ID NO: 59214 - RNA, 58 nt, Pseudomonas aeruginosa PA01
cccugccggugaucgccgcgccgcagccacagcagagcgucgcggacuaccugcaggg

SEQ ID NO: 59215 - RNA, 80 nt, Pseudomonas aeruginosa PA01
cccugcgcagcgcgaggccagccagcaacucuuggacgaagccgcggacaaguugccgccggccuuccgcgaacgccugg

SEQ ID NO: 59216 - RNA, 85 nt, Pseudomonas aeruginosa PA01
cccugcgggccgaucagcagguaccagggcagcucguugcgccagcgcucgcugcggccgcgguacaggcuggaggucuucaggg

SEQ ID NO: 59217 - RNA, 129 nt, Pseudomonas aeruginosa PA01
cccuggagaccuucgccgggccgcuugaaaucgcuaccuucccggcauccgcggcgggaccggaccugcgcgaacuggugcugggcucugagggacgcuucgggaucauuuccucggugaaggugcggg

SEQ ID NO: 59218 - RNA, 123 nt, Pseudomonas aeruginosa PA01
cccuggaucaggcccaugaauucguucaucagguugcgguggaaccauggcggacggaagguguucucggccaccauccagcgcggcgggaagaucacgaagucgauguuggccaggccgggg

SEQ ID NO: 59219 - RNA, 109 nt, Pseudomonas aeruginosa PA01
cccuggucucgcguuucaaugcgcugccggcgcaguccugcauggagcugccgcuaccgaugcuggaguugcugcgcuacggcggcgaguugucggaacagagccaggg

SEQ ID NO: 59220 - RNA, 77 nt, Pseudomonas aeruginosa PA01
ccgcggugggcgggagcgagccgguuguucgaggcgcugucgcgccugcgauuuccugcgcguuccguccugcccgg

SEQ ID NO: 59221 - RNA, 117 nt, Pseudomonas aeruginosa PA01
ccgcuagaggccgaguccuucgcuggcugcccagcgcgccaucaggcgguucgacggcaggcuuucgucgagcagcuugcgcgcgcuuuccacccccgcgaccggcaggcccugcgg

SEQ ID NO: 59222 - RNA, 64 nt, Pseudomonas aeruginosa PA01
ccgcuccguggugguggucuugcccgcgucaacgugggcacagauaccgauauuacgguagcgg

SEQ ID NO: 59223 - RNA, 61 nt, Pseudomonas aeruginosa PA01
ccgcugaugcucgccggccugcugcuguucaccuucggcuucuucggcgcgcacucggugg

SEQ ID NO: 59224 - RNA, 76 nt, Pseudomonas aeruginosa PA01
ccgcgacacuugucuugcgcucggugcggcuacuguauaaaaagcgcgccacccguugcgagagagccugucgugg

SEQ ID NO: 59225 - RNA, 95 nt, Pseudomonas aeruginosa PA01
ccgcgccagccgggcgccgaggaacuggcccuggccgccgcccugcucuaccaggccggcgccgaggccagugcgcaccagcccggccuggccgg

SEQ ID NO: 59226 - RNA, 100 nt, Pseudomonas aeruginosa PA01
ccgcgagauacgcgaggcgcugcuggcggcggaacaggcgccggaggcggagccggcgccccuggaagagccgccggaacccaggcgccagcggaagagg

SEQ ID NO: 59227 - RNA, 87 nt, Pseudomonas aeruginosa PA01
ccgcgaggaccucgggccauaccugcgccagccccgggcccugagcgcggagcguuugcgcgaggugcuggcgccgaggagccgcgg

SEQ ID NO: 59228 - RNA, 88 nt, Pseudomonas aeruginosa PA01
ccgcgcacgcccaggcggcgcgccucuuccagcagccagucgcagaucggcuggcccugguggcggcgccccugcugggugaugaagg

SEQ ID NO: 59229 - RNA, 59 nt, Pseudomonas aeruginosa PA01
ccggagcgcgccaccgccagcuucagcagcggcacgcuggcgcuggcgggcugcuccgg

SEQ ID NO: 59230 - RNA, 64 nt, Pseudomonas aeruginosa PA01
ccggaagcccugagccgcucugacugaagcagggugaggcgaggcggaucgggccguuuuccgg

SEQ ID NO: 59231 - RNA, 71 nt, Pseudomonas aeruginosa PA01
ccggcacagggucgggugcucagccggcgcgagacgauccugcugguccuguucgcccugacccugcacgg

SEQ ID NO: 59232 - RNA, 108 nt, Pseudomonas aeruginosa PA01
ccggcagcaggguguagaacucguacuucggcuuggccugggccggcgucugcguuugugcgggcugcugggccuggccguucugcugcggcugcuugcccugcacgg

SEQ ID NO: 59233 - RNA, 68 nt, Pseudomonas aeruginosa PA01
ccggcagcgcgccgauacccaugccggagaccaccgccucggucauggcgucggcgguguugaccugg

SEQ ID NO: 59234 - RNA, 83 nt, Pseudomonas aeruginosa PA01
ccggccagcccgcgcggcucgcugaaagccgagccgggccaggcgauggcgcggcugguagaugaccugcgccggguugccgg

SEQ ID NO: 59235 - RNA, 69 nt, Pseudomonas aeruginosa PA01
ccggcccgagcggccugccccgggcgcagccaacaggccacgccaggggcugcgccgcucagggcgcgg

SEQ ID NO: 59236 - RNA, 67 nt, Pseudomonas aeruginosa PA01
ccggccggcgccuguccgaccugcgacggccucggcgugaagcaauucuucgacgcgcgccgggugg

SEQ ID NO: 59237 - RNA, 124 nt, Pseudomonas aeruginosa PA01
ccggccggcuugucgcgggcggccgggucgugggcgggcacugucagggucaugcgcagguuuccaucggcgugauccccgcguugauaccccagcccggccgcgggacacaagccaggcgcgg

SEQ ID NO: 59238 - RNA, 63 nt, Pseudomonas aeruginosa PA01
ccggccugucuucugccggacagcccuguugucccgcuguugcccggcagacagucaggccgg

SEQ ID NO: 59239 - RNA, 60 nt, Pseudomonas aeruginosa PA01
ccggcugguagccggccggcaggcgcaggcgcgcgccggccuugagccggugccggucgg

SEQ ID NO: 59240 - RNA, 61 nt, Pseudomonas aeruginosa PA01
ccgggccgcgacggccgcccaggcacuccucgacguagcucugcuucggcuucuggcccgg

SEQ ID NO: 59241 - RNA, 69 nt, Pseudomonas aeruginosa PA01
ccggcgcgccagaacucgaccggucgcuacccguuacgcaggccggucgguacgcucuggcgcugucgg

SEQ ID NO: 59242 - RNA, 63 nt, Pseudomonas aeruginosa PA01
ccggcuccgccgguugcggcaucgccgaacagaucaucgccgccaugcaacuggagggccugg

SEQ ID NO: 59243 - RNA, 68 nt, Pseudomonas aeruginosa PA01
ccggcugcggguugucgcccuccggcugggcgcugaacaguaccgggccgccggcgauacgcuccugg

SEQ ID NO: 59244 - RNA, 85 nt, Pseudomonas aeruginosa PA01
ccggcgucuggcaacuguucuccgccggccgcucgcaggccauggccggcgugccggacuggguggugagugccgaggaugccgg

SEQ ID NO: 59245 - RNA, 81 nt, Pseudomonas aeruginosa PA01
ccgggcgcuucuccggcucgacgccggcgagguccuggccguugaggcggaucucgccgcuguccggcuggucgaagccgg

SEQ ID NO: 59246 - RNA, 64 nt, Pseudomonas aeruginosa PA01
ccgggcgauggagucguccgccgaacguagcgcgcggcuggcggaagaacucgaugacgcccgg

SEQ ID NO: 59247 - RNA, 75 nt, Pseudomonas aeruginosa PA01
ccggggucagcucggcgaugccgcaacugaaggugcagcgcaggucggucgguugcgccggguaguggaucucgg

SEQ ID NO: 59248 - RNA, 86 nt, Pseudomonas aeruginosa PA01
ccggguccugccgcgccaggcggcgcaggccgagaccgaccacgucggcgguggcauggucgcgcuggcugaagcggccggucugg

SEQ ID NO: 59249 - RNA, 74 nt, Pseudomonas aeruginosa PA01
ccgggucgaccaccauaccuaucgcuucgccgagaaggccgagcgcgaaggccugguggugauggacgacccgg

SEQ ID NO: 59250 - RNA, 88 nt, Pseudomonas aeruginosa PA01
ccggguuucgucaccgccgcgauccucggcuucgcccauaccgucggcgaguucggcguggugcugaugaucggcggcaacaucccgg

SEQ ID NO: 59251 - RNA, 66 nt, Pseudomonas aeruginosa PA01
cgucgcgaggccaucgagcaggccgccgcgauccgccugcggccaguacugaugaccaccgcggcg

SEQ ID NO: 59252 - RNA, 82 nt, Pseudomonas aeruginosa PA01
cgucggcaccggcaaacgguuuccagcauugccgucgaauucugccuggccggcgaaccuggcaacuggaugcugcucgacg

SEQ ID NO: 59253 - RNA, 129 nt, Pseudomonas aeruginosa PA01
cgucggccaggccggcuuccagcagcgggaucaggcccagcugggucgcggucggguagcagcccggcacggcgaucaggcgggccuggcggaucuucucgcgguucacuuccggcaggccguagacag

SEQ ID NO: 59254 - RNA, 56 nt, Pseudomonas aeruginosa PA01
cgucggcccauuccggguggucugccagcucggcgaacuugcggaacuggcugucg

SEQ ID NO: 59255 - RNA, 61 nt, Pseudomonas aeruginosa PA01
cgucggccucgcguugccagcggauggccaggacuuccaggccggcggcgcgagccaggcg

SEQ ID NO: 59256 - RNA, 82 nt, Pseudomonas aeruginosa PA01
cgucggcgacggcagcccgcugaagaugccgcgcggccucaacgcgcaauggaaucucggcggccugcacuaugcgccgccg

SEQ ID NO: 59257 - RNA, 62 nt, Pseudomonas aeruginosa PA01
cgucggcggccagcuucauccgcaggccgaacagcaaggccagcagcaaggccaggccgaug

SEQ ID NO: 59258 - RNA, 83 nt, Pseudomonas aeruginosa PA01
cguccgggucaacuccggcggcagcccgggcaacggcagcggcgcggcgccgcuguugccggggccgccgcucgacgcggaug

SEQ ID NO: 59259 - RNA, 61 nt, Pseudomonas aeruginosa PA01
cgucgagcagaccaaccgggcgcgcgaagacagcaugcgcuauuccgccuggaugcucgcg

SEQ ID NO: 59260 - RNA, 59 nt, Pseudomonas aeruginosa PA01
cgucgagccgggcgagggacucgucgaggucgucgagggccuuguaggccggaucgacg

SEQ ID NO: 59261 - RNA, 81 nt, Pseudomonas aeruginosa PA01
cgguuguucgccggggagcgcugguucgcccuggucgagcaacugcucgccggccugcggcgcuuccacgaagagcuaccg

SEQ ID NO: 59262 - RNA, 55 nt, Pseudomonas aeruginosa PA01
cgguucgaccaagaucgccaagcaacugauggucuaugccggcgagucgaacaug

SEQ ID NO: 59263 - RNA, 72 nt, Pseudomonas aeruginosa PA01
cgguggggcgccccugguccagcggcagcagguagagaucggggcgccgacgguccaggcgcgccaccagcg

SEQ ID NO: 59264 - RNA, 89 nt, Pseudomonas aeruginosa PA01
cgguguacaaggccucguuuuccggcgcgcugaagguccugcucgaccuguugcccgagcgcgcccuggagcacaagguggugcugccg

SEQ ID NO: 59265 - RNA, 91 nt, Pseudomonas aeruginosa PA01
cggugugcgcugcaucggcgcgccgaaggcgauauggccgauuucgaugacgccauccuucggcgugauccgcagguagcugagcaggccg

SEQ ID NO: 59266 - RNA, 80 nt, Pseudomonas aeruginosa PA01
cgucauccaguucgucgagggcucgggcgcagcgccaggcguaggcgucgucggccucguucucgaugaacaggcugaug

SEQ ID NO: 59267 - RNA, 65 nt, Pseudomonas aeruginosa PA01
cguagccgaugugcggguucagugcggugaccagcaucaggccgcgcuccagcaggucggccaug

SEQ ID NO: 59268 - RNA, 71 nt, Pseudomonas aeruginosa PA01
cguggagcgcgcgcugaaugccguggagcgccaggaacgccucugcggcagggguuugcgccugauccgcg

SEQ ID NO: 59269 - RNA, 89 nt, Pseudomonas aeruginosa PA01
cguggaagggcgccuggacaucgcccgggugaucuacaagaccgaccuguggagcgccugugggaucgucccggcgcgccuggucuacg

SEQ ID NO: 59270 - RNA, 97 nt, Pseudomonas aeruginosa PA01
cgugccgccguaaccgcagccuggcgaucgaagcgcaggaccaggcccugcucgcucuccccgaccgccagcaguugcggcgcagacgucggcagcg

SEQ ID NO: 59271 - RNA, 87 nt, Pseudomonas aeruginosa PA01
cguugucgcugaaacugcaugagcggcucgaccuggggaucgccguggacaccccggacggccuguucgugccggugcugcgcgacg

SEQ ID NO: 59272 - RNA, 61 nt, Pseudomonas aeruginosa PA01
cguugcguucggacagcccggccacgcucugcccgcggcucuucagcgucuggauguacug

SEQ ID NO: 59273 - RNA, 82 nt, Pseudomonas aeruginosa PA01
cguugcaccuggugagcgcgguaugcccggacuacucgcacuccagcgaugccgagggcaagccgcgcuacaccuucgagcg

SEQ ID NO: 59274 - RNA, 65 nt, Pseudomonas aeruginosa PA01
cguuccgacgaacaguugcgcagcgccuaugcggccgaggccgcacagcuccgcgacugggaacg

SEQ ID NO: 59275 - RNA, 64 nt, Pseudomonas aeruginosa PA01
cguucgaucaguugcggcuggccgagcugggcgccggcgagguugaccgacagcgggccgaacg

SEQ ID NO: 59276 - RNA, 78 nt, Pseudomonas aeruginosa PA01
cguucaucaaugccggcgcccuggugaucugcgacaucaaccagucgcguuucgccgcgccggcgcaaucgaugcgcg

SEQ ID NO: 59277 - RNA, 128 nt, Pseudomonas aeruginosa PA01
cuacgccgcaacaguucgucgauggcgccggucugggcgucggcgauggcgccgcgcgggaucaggaaggcgaugcgcggggcaucgcuggcccagcgcgaggcgccccaggccagguagucggcgag

SEQ ID NO: 59278 - RNA, 73 nt, Pseudomonas aeruginosa PA01
cuccaccaggcgccgcuugaugguuucggcggcauucugcgcggccuugccguucaggucggugcccgaggag

SEQ ID NO: 59279 - RNA, 81 nt, Pseudomonas aeruginosa PA01
cucgaccacccgccgcugguggucgacgucaacgaccccgaguauggcgaaggccgcccgguuggcgaacuggacuacgag

SEQ ID NO: 59280 - RNA, 129 nt, Pseudomonas aeruginosa PA01
cucgaccaggcccagaucagcgaccgccaccgcuugcgccggcagcuccacgaacugcgcaagcagcccgacgacgcgcgccuggcgcagugggucgagcgcuuccagaccuccugcgccaaggucgag

SEQ ID NO: 59281 - RNA, 63 nt, Pseudomonas aeruginosa PA01
cucgaccugcugccgaguauccuucccguggccgugucgcggcaggaggacggcagcgucgag

SEQ ID NO: 59282 - RNA, 72 nt, Pseudomonas aeruginosa PA01
cucgagagcggccugcgcuucggcgacauggacaucuuccaucgccacgaaagcauggccggcaauggcgag

SEQ ID NO: 59283 - RNA, 78 nt, Pseudomonas aeruginosa PA01
cucgaguucccgcuggcagauggcccugaccucgucuuccuggccaccggggccacgugccagcaggaguuccucgag

SEQ ID NO: 59284 - RNA, 78 nt, Pseudomonas aeruginosa PA01
cucgaugggacggucgagcagcacgucgagguucucgaaggcgacccggcgcagaugcgcgucgaucagucggucgag

SEQ ID NO: 59285 - RNA, 99 nt, Pseudomonas aeruginosa PA01
cucgcccggcacccgcuccaggccgccggcgaccugccaggacagcggcuugagcaacugguugcgcggggucagcgagcggauggugaccaggucgag

SEQ ID NO: 59286 - RNA, 65 nt, Pseudomonas aeruginosa PA01
cucgccgacccgcaugcccagcgagcggccgacgcaggcgacuuccagggagugggucaggcggg

SEQ ID NO: 59287 - RNA, 103 nt, Pseudomonas aeruginosa PA01
cucgccgguacggccgaagccgcagaucacuucgucggcgaugaacaggaugucguacuuggcgaggaucucgcggaucuucggccaguagguguccggcggg

SEQ ID NO: 59288 - RNA, 76 nt, Pseudomonas aeruginosa PA01
cucgcgccugcucagccugcggaccaucggccgcgcccucggccggcuguuguuucccaaggcggaacaggccggg

SEQ ID NO: 59289 - RNA, 120 nt, Pseudomonas aeruginosa PA01
cucggcgcuagcgguuucggcuaccagguggcgcgccaguucggccacgaggugcugccgacccgcgccgggcuggugccguucaccaucaccgaccagcugaaggagcugugcgccgag

SEQ ID NO: 59290 - RNA, 70 nt, Pseudomonas aeruginosa PA01
cucggucagguagccgccuuccucgaagccgacguagcccggaggcgcgccgaucaggcgggccaccgag

SEQ ID NO: 59291 - RNA, 70 nt, Pseudomonas aeruginosa PA01
cucgucggccgccgccgacuugucggugauggagaagaaccagauaccgacgaaggcgacgaucaucgag

SEQ ID NO: 59292 - RNA, 59 nt, Pseudomonas aeruginosa PA01
cucgucggccugcgcggcgaaugcggcgacgccgagggaaagugcgcaggccaggcggg

SEQ ID NO: 59293 - RNA, 97 nt, Pseudomonas aeruginosa PA01
cuccuugagcggagcgcccaucugcgacaucggcguaccgccgccgaacucggccuggagggucacgcugucguggcugagcaagccgcugaaguag

SEQ ID NO: 59294 - RNA, 61 nt, Pseudomonas aeruginosa PA01
cuaucaggccugggguagggagggcgacacgugggugucgcggaucagcgccaggggauag

SEQ ID NO: 59295 - RNA, 87 nt, Pseudomonas aeruginosa PA01
cuguuggggcugcccaccaccaggaccaugucgcacuggucggccaguuccuucacggcauccuggcgguucuggguggcauagcag

SEQ ID NO: 59296 - RNA, 107 nt, Pseudomonas aeruginosa PA01
cuguucggaggucagcuccagguagaugccggcggcuuccagcaagucggcgcugccgcucuugccggagaccgcgcgguuaccguguuuggcgaccuugccgccag

SEQ ID NO: 59297 - RNA, 57 nt, Pseudomonas aeruginosa PA01
cuguacuucgccgccaagcaggucgacaucguccagcgcagccaggacgaagagcag

SEQ ID NO: 59298 - RNA, 66 nt, Pseudomonas aeruginosa PA01
cugugggcggucaacgccagcaccggcaguuccgcgcagccgggcagcgcgcggaucgcccgacag

SEQ ID NO: 59299 - RNA, 68 nt, Pseudomonas aeruginosa PA01
cuggaggugcgcaggccgagcgguccgaggucgaccucgaggacauaggcggguuugcgugccuuggg

SEQ ID NO: 59300 - RNA, 68 nt, Pseudomonas aeruginosa PA01
cuggagucaggcucggugguuccgcugaaaccgaaacgcggguucagcggguugaggcugacgucgag

SEQ ID NO: 59301 - RNA, 95 nt, Pseudomonas aeruginosa PA01
cuggccaggucgcggguaucuucgcggcgaauuuccccggcagcgaaggccugcaugagaucguccgcguagacauagccuagacuuguacccag

SEQ ID NO: 59302 - RNA, 121 nt, Pseudomonas aeruginosa PA01
cuggcacagccgucgcggcaugcuggaacuggaugugcugcuggugccuuucgugcaggagguuuacccgggccuggacgccgaggaccaggcgcgcuuccgcaagcugcuggagugcgag

SEQ ID NO: 59303 - RNA, 107 nt, Pseudomonas aeruginosa PA01
cuggucgucgcggccaucgcggacuucgccggccaguugcuugagggucggauucaucgcucggcucccggcuggccgcugaacagcgcguccaggcguucgaucag

SEQ ID NO: 59304 - RNA, 58 nt, Pseudomonas aeruginosa PA01
cuggggcggcuuguugcgcccgcgggucucgacccgcgcgcggaucucgccgcgccgg

SEQ ID NO: 59305 - RNA, 60 nt, Pseudomonas aeruginosa PA01
cugggcgaucagcggccgcaggcaggcgaacggcgugcucagcggcccgggaucgagcag

SEQ ID NO: 59306 - RNA, 108 nt, Pseudomonas aeruginosa PA01
cuggccgccggcagccucggccuggucggccaucccggucccuggccggccuguccgcgcgcgguggagaagccggugacccuggcgaucggcccggaaggcggcugg

SEQ ID NO: 59307 - RNA, 84 nt, Pseudomonas aeruginosa PA01
cuggccugcacccgcggcuggcugcgcuaccguuugccgcagcgccuggugcggacccacagccagccgcugugcaucggccag

SEQ ID NO: 59308 - RNA, 78 nt, Pseudomonas aeruginosa PA01
cuggcgcguaccgucggcuggaucucgcacuggcaggaaaugcucuccggccccuacaagaucggccgcccgcgccag

SEQ ID NO: 59309 - RNA, 82 nt, Pseudomonas aeruginosa PA01
cuccccggugcgcgccuucaagagcgucggcggcaccccgcuguucuucaagcacgccgaaggcgccuauguacuggacgag

SEQ ID NO: 59310 - RNA, 92 nt, Pseudomonas aeruginosa PA01
cucugcaccugcucggccagauggcggaucagcgcgugcucaccguccaguuccaccgccgcgcgcugcagccacucggccaggugcagcag

SEQ ID NO: 59311 - RNA, 96 nt, Pseudomonas aeruginosa PA01
cucugguucaccugcaccacgccgcugcucccggcgaaggcgcgaucguccgucgagacgcugcguccccccgggaccggaguggccgaaccggag

SEQ ID NO: 59312 - RNA, 78 nt, Pseudomonas aeruginosa PA01
cucuucuucggcggccuguuccugcuguucaagagcaccauggagaucuaccacagccuggaaggcgcggaagaagag

SEQ ID NO: 59313 - RNA, 59 nt, Pseudomonas aeruginosa PA01
cugacggugaaggccggcggcagcuucauccggcucgacgcaagcggcaucgccaucag

SEQ ID NO: 59314 - RNA, 57 nt, Pseudomonas aeruginosa PA01
cugcaucggcggcggcgaggcgaccgcgaucgccgucgagcgcuugcgcugaugcag

SEQ ID NO: 59315 - RNA, 93 nt, Pseudomonas aeruginosa PA01
cugaucgacuucgccugcggcaugggcgacgugaugaagcagcguucgcugcuggugccgcgcgcccaugggcgggugcuggagaucggucug

SEQ ID NO: 59316 - RNA, 63 nt, Pseudomonas aeruginosa PA01
cugcugggccucccggcgcagacgacgcgccucuucuugcagguagcggcgccgggccagcag

SEQ ID NO: 59317 - RNA, 80 nt, Pseudomonas aeruginosa PA01
cugcuggugcgccugcucgguugccugcuggugcugcccuggcugacggcgcuggcgcaaccggccaacgcacucggcgg

SEQ ID NO: 59318 - RNA, 81 nt, Pseudomonas aeruginosa PA01
cuggaccaaccgcagcgaggcgucuggcacggcgaucuccaugaacggauugccgccgcgcgccucgauccacucggccag

SEQ ID NO: 59319 - RNA, 81 nt, Pseudomonas aeruginosa PA01
cuggaacagacgccgcccuccagcggccgcaaccagggcgagcuggaguucgccgggcgccgcugggaguggcgcacccag

SEQ ID NO: 59320 - RNA, 63 nt, Pseudomonas aeruginosa PA01
cuggaagaaggugcggacgagguauucgaggaaauccucgccgccgcuacguccuacuuccag

SEQ ID NO: 59321 - RNA, 81 nt, Pseudomonas aeruginosa PA01
cugcuccggcagcgaccaguccgccagggccgccggcccggaggccggggccgcaucggcgggcaggucgaggccggagag

SEQ ID NO: 59322 - RNA, 83 nt, Pseudomonas aeruginosa PA01
cugcucgaggagcgcccggcgaugcgcgcuugccggcgcguggaaaagacggcgagcgcuuccugaggcgcguagcagagggg

SEQ ID NO: 59323 - RNA, 81 nt, Pseudomonas aeruginosa PA01
cugcgccgccuuggccgcgcccugcggggugaucgguccguuguugccgaucaggccgcaggcguggcccucgaugcgcag

SEQ ID NO: 59324 - RNA, 76 nt, Pseudomonas aeruginosa PA01
cugcgcgagcagggcgugcgcccggcgaauuucuacuacgaaaaguucgcugccagcgcggccugaacccgagcag

SEQ ID NO: 59325 - RNA, 57 nt, Pseudomonas aeruginosa PA01
cugcgcgccaauggcgauccgaagcugaaccgccuggcggaugucgacggcccgcag

SEQ ID NO: 59326 - RNA, 90 nt, Pseudomonas aeruginosa PA01
cugcgggcauugcgacaacugcguggacggcguggaaaccugggaugccaccgaauccgcgcgccaggcgcugucggcgaucuaccgcag

SEQ ID NO: 59327 - RNA, 69 nt, Pseudomonas aeruginosa PA01
cugcgugcggcgccggcgaugccggccagggagacggcucccaauacggcgaccagcgccgccaggcag

SEQ ID NO: 59328 - RNA, 60 nt, Pseudomonas aeruginosa PA01
cugccgcccaguugccgccagagccgcgccgagcggaugccggcgagcagcagggcgcgg

SEQ ID NO: 59329 - RNA, 82 nt, Pseudomonas aeruginosa PA01
cugccagggcaugcgcggcuggucggcggccagccgggcguuguccggcgaggccaauggcugaggcgcuucguccagguag

SEQ ID NO: 59330 - RNA, 87 nt, Pseudomonas aeruginosa PA01
cugcgacucgccgaagcccuggaacaccugcagcagcaacggcagcgccaacaggaugaguuccagcgccuucaggccgacuggcag

SEQ ID NO: 59331 - RNA, 64 nt, Pseudomonas aeruginosa PA01
cugccgcuguucggugccuacaagcguggucucaucgccacccagaaagcgcuggauacggcgg

SEQ ID NO: 59332 - RNA, 65 nt, Pseudomonas aeruginosa PA01
cugccggccaggcggguguucagcucgaacuugccgaggguguuggcaucggccauggccggcag

SEQ ID NO: 59333 - RNA, 64 nt, Pseudomonas aeruginosa PA01
gagcagcuggaucgggcgccgcgcccugcgcgccaagggccaggccucgucgcucuaucuguuc

SEQ ID NO: 59334 - RNA, 78 nt, Pseudomonas aeruginosa PA01
gagcaccuugggcaaagucugccgcacuacauguugccgucggcguucgugguccuggcggagcugcccaagacgcuc

SEQ ID NO: 59335 - RNA, 78 nt, Pseudomonas aeruginosa PA01
gagcacuucguaggccugcggaucggugaccuucuucggcuugccgcgcuugucggucucguaggcguagaagcccuu

SEQ ID NO: 59336 - RNA, 59 nt, Pseudomonas aeruginosa PA01
gacgacccgcucgagcgucucuacgccgggcucuucggcgcgcucggggugggcuuguu

SEQ ID NO: 59337 - RNA, 63 nt, Pseudomonas aeruginosa PA01
gaccgcccagaugaggggaagaucgauacccaugucucaguuccucuuguccuggucgcgguc

SEQ ID NO: 59338 - RNA, 73 nt, Pseudomonas aeruginosa PA01
gacgcuccggccaaccgccacggaucgccuugaucaccgcggcgacuucgcgcggaugguggccguaaucguc

SEQ ID NO: 59339 - RNA, 63 nt, Pseudomonas aeruginosa PA01
gacgcuggcuaacccgccauagcuggaauggcgguaauaaugcugcggcggguaagcaggguc

SEQ ID NO: 59340 - RNA, 81 nt, Pseudomonas aeruginosa PA01
gacgcugguggugaacggugugagcaugccacugaagguggacgccgauggcagcuucgaccgcccguucgccuucccguc

SEQ ID NO: 59341 - RNA, 66 nt, Pseudomonas aeruginosa PA01
gacgugccggggcaacgcaccagccaucucgacaucacgcucggcgcgcaggccaucggcaucguc

SEQ ID NO: 59342 - RNA, 60 nt, Pseudomonas aeruginosa PA01
gacgucgccgcguuacgccaggacccgcaacugacggugcuggaagaagcggcgaugauc

SEQ ID NO: 59343 - RNA, 69 nt, Pseudomonas aeruginosa PA01
gacuaaucguucacauuugacuuaacuaguggccaaaugcuggcugcuuauuagaaauaggcauuaguc

SEQ ID NO: 59344 - RNA, 60 nt, Pseudomonas aeruginosa PA01
gacucccgugccgaucagccauugcgccaggcucgcguugaggcugccgguaacgggguc

SEQ ID NO: 59345 - RNA, 81 nt, Pseudomonas aeruginosa PA01
gacaugcggguggucggccaggugcgcgguggcccuggccauguggguggacagcgcgcgguuggccucgaucaccuuguc

SEQ ID NO: 59346 - RNA, 70 nt, Pseudomonas aeruginosa PA01
gaccggauggcgucggccgcagaugaacucgaggauaccuuugagcguggccagccgcgccucucugguc

SEQ ID NO: 59347 - RNA, 76 nt, Pseudomonas aeruginosa PA01
gaccuccaccaguccgggagcgauggcguugacggugaugccgucgccgcccagcucgcgggccaggcugcggguc

SEQ ID NO: 59348 - RNA, 73 nt, Pseudomonas aeruginosa PA01
gaccugcaaggugccuugcucaagcucggccuggccuucgacgggcaacuggagcgcggcaacuggcgcgguc

SEQ ID NO: 59349 - RNA, 79 nt, Pseudomonas aeruginosa PA01
gaccugccaggccagcgggucgcgccacaggccgaugacacggaaggccuggcgaugggcgugcuggcccuggcggguc

SEQ ID NO: 59350 - RNA, 75 nt, Pseudomonas aeruginosa PA01
gaccagcagcggcacgcgcgcggccaucucgaaccagugcaucuuguaccagaggccgcgcucgccgagcauguc

SEQ ID NO: 59351 - RNA, 55 nt, Pseudomonas aeruginosa PA01
gaccagcgccaggccggccccagccuccaccagggcgcgggcgagggcguagguc

SEQ ID NO: 59352 - RNA, 66 nt, Pseudomonas aeruginosa PA01
gaccaggcugccggcaccggccuugaccaggcugcccugguacuggcgcugggcggcggccugguc

SEQ ID NO: 59353 - RNA, 90 nt, Pseudomonas aeruginosa PA01
gaccccagaagcggaccuggccgacgagaggcugacugcgggagguuuccuuuccggcgggcagccgcuguggaaggcauucuggcuguu

SEQ ID NO: 59354 - RNA, 63 nt, Pseudomonas aeruginosa PA01
gaccccguccggaccgaucaggccgaccaugcgguuggccgggaucuccaggcugacgucguc

SEQ ID NO: 59355 - RNA, 57 nt, Pseudomonas aeruginosa PA01
gaaugggagcugggccugcaggugaucccggagaaccagcaggacagcuucgacuuc

SEQ ID NO: 59356 - RNA, 80 nt, Pseudomonas aeruginosa PA01
gaaugggggccagcagggcuucugcggcgaucuucuccgggccuuccaggggcaggcugucgcggaagaucgggccuuuc

SEQ ID NO: 59357 - RNA, 61 nt, Pseudomonas aeruginosa PA01
gaauggguguucugccauccggagguggaaacccuggaauugcagggcuaccgcaucauuc

SEQ ID NO: 59358 - RNA, 65 nt, Pseudomonas aeruginosa PA01
cuguuuuccgccggcaucggccugcacaccuucuaccuuggccugcagaaggucggcggcgacag

SEQ ID NO: 59359 - RNA, 70 nt, Pseudomonas aeruginosa PA01
cuucuucagcuugaucacgucgaacaguuggcagaccgcuucauccuugucgcugaucagcucgaagggg

SEQ ID NO: 59360 - RNA, 88 nt, Pseudomonas aeruginosa PA01
cuucuucuucguggcguucuggcguagcgacaauccguucauggcgcagcacuggguggaaaucgccacgguggacuacggagugaag

SEQ ID NO: 59361 - RNA, 62 nt, Pseudomonas aeruginosa PA01
cuucccgucgucucgucggucacagcuggaaagggcggcuggccgagcgauucggcgggagg

SEQ ID NO: 59362 - RNA, 59 nt, Pseudomonas aeruginosa PA01
cuuccgccccggcggcgcgggcaccggccauguccuugaugucgccgccggcgcagaag

SEQ ID NO: 59363 - RNA, 58 nt, Pseudomonas aeruginosa PA01
cuugaccacgauugcgcccaggaagcugccguccucggcgcgcaccgcgugggacagg

SEQ ID NO: 59364 - RNA, 59 nt, Pseudomonas aeruginosa PA01
cuucugcgccggcggcgacaucaaggacauggccggugcccgcgccgccggggcggaag

SEQ ID NO: 59365 - RNA, 100 nt, Pseudomonas aeruginosa PA01
cuugaugucgaucacccggaugcuggcgaaguagccgcugucgaagaucgagcugaccaucaguugcaccaucgccgggucguccacguguggcgucagg

SEQ ID NO: 59366 - RNA, 100 nt, Pseudomonas aeruginosa PA01
cuugcagcuuuccaggugcaccaccaugcccuugccggcggacagguggccaacgaucgggucgccgggaaucggcgugcagcacuuggcguagcucagg

SEQ ID NO: 59367 - RNA, 129 nt, Pseudomonas aeruginosa PA01
cuugccgugugccgucaagggcaaggccucgacccggacgcaggcaugcgggcgcugccaggugggcaguuggcggagcagggccugcgggcuggcgucggcuuuucccguccaggcgcagagcaguug

SEQ ID NO: 59368 - RNA, 130 nt, Pseudomonas aeruginosa PA01
cuuggcucgcuggagcgccucggcgucggcgacgccgaccuggaugucauugcggcccuggacgaucagggucgggaugcgcaggcggccgaacgcgcgggccgggucuucgcggaacagcgagaucagg

SEQ ID NO: 59369 - RNA, 82 nt, Pseudomonas aeruginosa PA01
cuuugcgccgccggcauguccggcucccagccuucggcgaucaaggcccagggccccuuccacggaccgcugguggccgaag

SEQ ID NO: 59370 - RNA, 87 nt, Pseudomonas aeruginosa PA01
gaaaacgccgcuggcgccgaggcaggcguggaccuucucgaacaggccgggcaggucggcuucggcuucgauguugucgguguauuc

SEQ ID NO: 59371 - RNA, 99 nt, Pseudomonas aeruginosa PA01
gaaaagaaaaccuugcuagagacagaagggcgggcugccugccggacgcuucccgcauccggcggacagcccgccccagguagucgguaucagucgauc

SEQ ID NO: 59372 - RNA, 83 nt, Pseudomonas aeruginosa PA01
gaaggcuugggagcgggcuccagcggcuugccgcacucggcgaacagcagcagcggagcgacccgcagguauuccaugacuuc

SEQ ID NO: 59373 - RNA, 73 nt, Pseudomonas aeruginosa PA01
gaagggcaagguggccaagcuggucugccccuaccaccaguggaccuacgagcuggauggccgccugcuguuc

SEQ ID NO: 59374 - RNA, 60 nt, Pseudomonas aeruginosa PA01
gaagugcugcgcaucgaaggcucgaucuucuucggcgccugcgacuaccugcaacgccuc

SEQ ID NO: 59375 - RNA, 90 nt, Pseudomonas aeruginosa PA01
gaaggugaucggcgccgugggcagcgcggccaucgccuggcgcaccgccggaucggcgagguagcgcagcacgccguagccgaggccuuu

SEQ ID NO: 59376 - RNA, 112 nt, Pseudomonas aeruginosa PA01
gaaguucuccgccacccaguacgccaugcucagcucgaccaugcuccugcugccgcgcuucaucggcggcuacuccggaaccauggucgagagccucggcuacgagcacuuc

SEQ ID NO: 59377 - RNA, 55 nt, Pseudomonas aeruginosa PA01
gaagugggcugggccguuggucugaaauacaccgagggcuucagcaagccgcuuc

SEQ ID NO: 59378 - RNA, 60 nt, Pseudomonas aeruginosa PA01
gaagagcgccgccagcgucacaguccgaugaaggacgucggcggcaugcugcgcucguuc

SEQ ID NO: 59379 - RNA, 81 nt, Pseudomonas aeruginosa PA01
gaagcccagcggguugaugucguagcucaccagcagguucuuggucugcugguaguggucgagcaucaucuugugcgucuc

SEQ ID NO: 59380 - RNA, 106 nt, Pseudomonas aeruginosa PA01
gaacacgcucgagcggacccuggccugccugcgcgagggcagcggggaaaucuucgucgacccggcguugaucccgcgggcgguccguccgcucaagcgcaugcuc

SEQ ID NO: 59381 - RNA, 58 nt, Pseudomonas aeruginosa PA01
aaggaugcgccagcggcaaccagggcaucugcucguggaagauccgcugcgcuuccuu

SEQ ID NO: 59382 - RNA, 76 nt, Pseudomonas aeruginosa PA01
aagucgaggaucucgccgggcuucaggcucagggugugcucgcccugcaggcggaacuccggcgcgucgucgaguu

SEQ ID NO: 59383 - RNA, 89 nt, Pseudomonas aeruginosa PA01
aacagcauccauggacgcaccccgggcacccugacggcuuguggcaagccggcgcagcauggccuggagggauucgccagggugccguu

SEQ ID NO: 59384 - RNA, 90 nt, Pseudomonas aeruginosa PA01
acggggugaucuucagcgccggcuacuauccuucgcggccgcgccgcuggcaggaggaaguggccagcgcgcugggccagaccaacccgu

SEQ ID NO: 59385 - RNA, 82 nt, Pseudomonas aeruginosa PA01
acggcggcgccggucucuccggcggccagcgccagcgcaucggccuggcccgcgcgcuguacgggcgaccggcgcugaucgu

SEQ ID NO: 59386 - RNA, 61 nt, Pseudomonas aeruginosa PA01
acgguugagaauggucuccuuggccugguucagcgccaccaccaccuugccguucugccgu

SEQ ID NO: 59387 - RNA, 130 nt, Pseudomonas aeruginosa PA01
acuacggcgaccugcgcgacaucaucgcgcggcgcuucgaggagggccgggugaucagcgucgguccggacgacacccugcucaccgccuuccagcgcaugcgccuggccgacguuucgcaauugccggu

SEQ ID NO: 59388 - RNA, 91 nt, Pseudomonas aeruginosa PA01
acgaagguguagccggggcgggugacgccguugucgaugcgcgugcuggcauugaccgugacgucgccggcggccuggaucaccgcugcgu

SEQ ID NO: 59389 - RNA, 68 nt, Pseudomonas aeruginosa PA01
acgcaggccggcgaggcguggccgacacggaucaccugguucggcucgcccuugccgcaguagggcgu

SEQ ID NO: 59390 - RNA, 62 nt, Pseudomonas aeruginosa PA01
acccuguccggcggcgaagcccagcgcauccgccuggccagccagaucggcgccggccuggu

SEQ ID NO: 59391 - RNA, 71 nt, Pseudomonas aeruginosa PA01
accgcggcgcgcucggaacccgguuuggccaggguggcccggccgauccggaucgggcgccuuccauaggu

SEQ ID NO: 59392 - RNA, 94 nt, Pseudomonas aeruginosa PA01
accgcuauccgaucaagucuuccgccgccgagucccuggagcgugucgcgcucgaugcgcugggcguggucggcgaccgacgcuggauggcggu

SEQ ID NO: 59393 - RNA, 79 nt, Pseudomonas aeruginosa PA01
accccauggcugcugugcgccagccccaacgcacgcaacgccucgaucaggcgcuggcgcaacggcucgucauaggggu

SEQ ID NO: 59394 - RNA, 82 nt, Pseudomonas aeruginosa PA01
acccucgaagccgagcugccggcggauggcggguugcucaugaacugccggcugccgcucgccgccggcgccacgggagggu

SEQ ID NO: 59395 - RNA, 65 nt, Pseudomonas aeruginosa PA01
acccucguggccuggcguccgcaggacggagacccgguccggcggaagcaggucggcgcgggggu

SEQ ID NO: 59396 - RNA, 56 nt, Pseudomonas aeruginosa PA01
accaggccgccgccuuccucgucgcaggcgaucggcgagaagucggucagcuuggu

SEQ ID NO: 59397 - RNA, 79 nt, Pseudomonas aeruginosa PA01
accacgccagcgccccggugccgccguggaaggauggcgucggccuuuccacggucagcaccgccggcgagaucgaggu

SEQ ID NO: 59398 - RNA, 83 nt, Pseudomonas aeruginosa PA01
accagauggccgacgccguagcgcuggccgcugcgguagaucgccgacagcgccuggcgcgcggauucgguggcaucccaggu

SEQ ID NO: 59399 - RNA, 69 nt, Pseudomonas aeruginosa PA01
accacgagcgcgagcugucgaccaaggagaucuucgucaccuacgugcugcgcaacaagcugcucuggu

SEQ ID NO: 59400 - RNA, 83 nt, Pseudomonas aeruginosa PA01
acagcauguucaggcccccuggccggccgccaggaccggcugccgcugguccugcgcgcugcgcaggguccgccagguguugu

SEQ ID NO: 59401 - RNA, 67 nt, Pseudomonas aeruginosa PA01
aguucugggagcuggagaaccucggccugccgcugcucggcguacuguucauccaggucgcggugcu

SEQ ID NO: 59402 - RNA, 73 nt, Pseudomonas aeruginosa PA01
aguucgucgcgguccugggggaagccggcgaccgucuccaggucaccggucuccgccgggcgguggcugagcu

SEQ ID NO: 59403 - RNA, 100 nt, Pseudomonas aeruginosa PA01
aguuccucaaccugcugcuggcgaacccggccggcgaugcaguggagcaccugaaggugcccaccgguuuccuucgccagcagcaggacagccuggaacu

SEQ ID NO: 59404 - RNA, 105 nt, Pseudomonas aeruginosa PA01
aggugaguacgucuuccucggacuuggccagguugccgaucucgcugcgcagcuuguucagcuccggcuugaucaggucggccgggcgcacgucgaugacuuccu

SEQ ID NO: 59405 - RNA, 61 nt, Pseudomonas aeruginosa PA01
aucacggcauaggcuucggugaacaucgcccggucggugagcagcucggucugugccgggu

SEQ ID NO: 59406 - RNA, 62 nt, Pseudomonas aeruginosa PA01
agggugcgcacgaagggcaccaugaucucgacguuggucaggcccauuucguugcggaccuu

SEQ ID NO: 59407 - RNA, 61 nt, Pseudomonas aeruginosa PA01
aggucggcgcgcugcuguucgucgacauggcccacgucgccgggcuggucgccgccggccu

SEQ ID NO: 59408 - RNA, 88 nt, Pseudomonas aeruginosa PA01
aggucgaguuucggcgccucggcuucggccuuggcguccuguaggucggcgccuaccggagccaggccgaaauccggcgcaucgaccu

SEQ ID NO: 59409 - RNA, 55 nt, Pseudomonas aeruginosa PA01
aggccgaguugcgccaggacgaagacguucucgacaccugguucagcuccggccu

SEQ ID NO: 59410 - RNA, 63 nt, Pseudomonas aeruginosa PA01
aggaggcgucggcgucgcccgcggcuaccugaaccggccggagcugaacgccgagcgcuuccu

SEQ ID NO: 59411 - RNA, 64 nt, Pseudomonas aeruginosa PA01
aggcgcgccaggucggacagguucucgcggcccagcaacggcacgcgccauccgccggcgcccu

SEQ ID NO: 59412 - RNA, 66 nt, Pseudomonas aeruginosa PA01
aggcgcugguggucgauccgggcaaggaagccuucguccguugccugggcugcaccaccagcggcu

SEQ ID NO: 59413 - RNA, 78 nt, Pseudomonas aeruginosa PA01
aggccaacgcgccgaccuuccauggcgcgcugguggacgccgccuacgccgagcgcuauccggagguggugguggccu

SEQ ID NO: 59414 - RNA, 87 nt, Pseudomonas aeruginosa PA01
aggcccacggccagggcuacggcgagcguaccgagggacacugggaguauccggugcgccugccguuccugauccgcgcgguggccu

SEQ ID NO: 59415 - RNA, 61 nt, Pseudomonas aeruginosa PA01
aggcccuggaucucgcccugccagugcuucuccaccacuucggccauggcuccggcggccu

SEQ ID NO: 59416 - RNA, 76 nt, Pseudomonas aeruginosa PA01
aggaugccugccucagcccgaacgccucguucgccuggguggaagagugcgccguuggggugaaacuggcgauccu

SEQ ID NO: 59417 - RNA, 69 nt, Pseudomonas aeruginosa PA01
agggccgggcgacgaacuggacgccgagaucgcggaaauccucggccguccggacgacgacccggcguu

SEQ ID NO: 59418 - RNA, 100 nt, Pseudomonas aeruginosa PA01
agggccugccgcagccggaugcgagccuguugcagcaggucuacguggcgccgcgaagcgaucuggagcaacaggucgcggggaucugggcggagguccu

SEQ ID NO: 59419 - RNA, 70 nt, Pseudomonas aeruginosa PA01
agggcgagcaggccguugccggacagugcgcgcucggcggagacauguccguagcgcgccugcaggcccu

SEQ ID NO: 59420 - RNA, 121 nt, Pseudomonas aeruginosa PA01
agggcuggcugcuaggcacccagucgcaccuggauuuuuugccggaaagccacaccgacuuuaucauugcgguccucggcgaggaguucggccuggucggcgucugccugcugcuggugcu

SEQ ID NO: 59421 - RNA, 86 nt, Pseudomonas aeruginosa PA01
agggagcugcucuccagcaccgcccggcgcgguucgcgcaaacggcgcuggagcggcgccagcaggugauggauggacagcucgcu

SEQ ID NO: 59422 - RNA, 59 nt, Pseudomonas aeruginosa PA01
aggcuuccuucaacuugucgccuggauagucauaggcgcucuggucguaggggaaggcu

SEQ ID NO: 59423 - RNA, 60 nt, Pseudomonas aeruginosa PA01
acuugcucggccagcucgggcugcuggugucaccggcggcgcgggucuggcugagcacgu

SEQ ID NO: 59424 - RNA, 77 nt, Pseudomonas aeruginosa PA01
agcacaucgggaccgacgccacgcgcuaucaggcagugagccagacgauuggcgcgggcguugagcucggcguagcu

SEQ ID NO: 59425 - RNA, 85 nt, Pseudomonas aeruginosa PA01
agagccagcgccuggagcuggaagugcucgcggugcugccgcaggagcguuucgcccgcgacgcgcuguucgccccgcuggcccu

SEQ ID NO: 59426 - RNA, 55 nt, Pseudomonas aeruginosa PA01
agcugcuggucaccauccucggcgccuggcgccugggcgcgguguaccagccgcu

SEQ ID NO: 59427 - RNA, 71 nt, Pseudomonas aeruginosa PA01
agcugggugaucgcccgcgagcugccgauccgcgccgaauccaggcgguccaggcgcgggcccauccaguu

SEQ ID NO: 59428 - RNA, 97 nt, Pseudomonas aeruginosa PA01
aggacuucgacaagagcgccggcuucggcgucuucucgcucaacggcgccuaccgggugacucgcaacgucaagcugagcgccggugucgauaaccu

SEQ ID NO: 59429 - RNA, 77 nt, Pseudomonas aeruginosa PA01
agcgguuucgaggcuacgaccgauuucagccgugucagugaaugugaugcccugauccuuugugugccgacgccgcu

SEQ ID NO: 59430 - RNA, 130 nt, Pseudomonas aeruginosa PA01
agcgucucgacaagccguuccuggaaggcgccgaggcgcgcgggcugcucaaccugaaaggccaccgcucggucggcggcaugcgcgcuuccaucuacaacgcccuuggccuggacgcggucgaggcgcu

SEQ ID NO: 59431 - RNA, 103 nt, Pseudomonas aeruginosa PA01
agcgcgcgcugacccuggcuaccgccggcgccacggucgagcgccaggcaccggacuggcgcgcgcgguugcuggcggugcucaccgaucccagcguggcgcu

SEQ ID NO: 59432 - RNA, 60 nt, Pseudomonas aeruginosa PA01
agcgcggcggguauugcgacaugacuuucugcaccgucucgcggaucgccugcucgcgcu

SEQ ID NO: 59433 - RNA, 57 nt, Pseudomonas aeruginosa PA01
agcgcugcgaccagucgguagccacccaguccuugagccauccguucucgcggcgcu

SEQ ID NO: 59434 - RNA, 87 nt, Pseudomonas aeruginosa PA01
agcggaucaccggauaggagaaguccgaggcgauuucauuggcguagcgcagugcgaugccuucggccuuuuccugggauauccguu

SEQ ID NO: 59435 - RNA, 56 nt, Pseudomonas aeruginosa PA01
agcggcgcggugguuggcgugcucgacgacggucggcgcggcagccgcuggcuguu

SEQ ID NO: 59436 - RNA, 55 nt, Pseudomonas aeruginosa PA01
agcggcgugcgcagcucgugggagacguuggccacgaaauccuugcgcaucugcu

SEQ ID NO: 59437 - RNA, 67 nt, Pseudomonas aeruginosa PA01
agcgaugcgcggcguuuccucgccgaaguggauuccgcuucggugauggucaacgccucgacccgcu

SEQ ID NO: 59438 - RNA, 57 nt, Pseudomonas aeruginosa PA01
agcgcagcaggcaggccugguagaucgccucauggggcggcuugccuucguugcgcu

SEQ ID NO: 59439 - RNA, 60 nt, Pseudomonas aeruginosa PA01
agcaggucgagcaguaccgcgcugccgacgaggccaagcgcggcaagauguucggcuucu

SEQ ID NO: 59440 - RNA, 67 nt, Pseudomonas aeruginosa PA01
agcaggucguggccggccagggucaggugguggaccacccauugcuccuggccgguccaggaaugcu

SEQ ID NO: 59441 - RNA, 72 nt, Pseudomonas aeruginosa PA01
agccgccgucucggccagcagggcgcggcggaauucaccgaccaggucguccugcgccgaaccgcugcggcu

SEQ ID NO: 59442 - RNA, 86 nt, Pseudomonas aeruginosa PA01
agcccuccuucgccgccaccuggcuggugccgcgccucggucaauucagcgcgucgcacccgcagguggaaguccgcguggaggcu

SEQ ID NO: 59443 - RNA, 62 nt, Pseudomonas aeruginosa PA01
caccuggcugcucaacucggcgaagcgcugcgcgucguugcccgguugcagcggcaccaggg

SEQ ID NO: 59444 - RNA, 84 nt, Pseudomonas aeruginosa PA01
caccugguugaggucgagcgccugcaggcgccgcuggcccuugcgcaggaaggcgcgcaggcgcuugaucaccuccgccgcgug

SEQ ID NO: 59445 - RNA, 83 nt, Pseudomonas aeruginosa PA01
cacggcgcccggcgaagucucgcggccgcugucgaagccugcggguugcgucucggccggcggcgcuucggcgggcagccgug

SEQ ID NO: 59446 - RNA, 57 nt, Pseudomonas aeruginosa PA01
cacuggagcagcgccuggaucggcuacucgcuggcccucuacggcgugcucgcggug

SEQ ID NO: 59447 - RNA, 55 nt, Pseudomonas aeruginosa PA01
caccgucgccuggcccagcggcgaguucggcgccaugggccuggaaggcgcggug

SEQ ID NO: 59448 - RNA, 96 nt, Pseudomonas aeruginosa PA01
caccggcgccugguagucgagcagguagucgccgcgcccgaguucgagcaugcgcaaggcggcguggugggugccggugcgguacaggcgcaggug

SEQ ID NO: 59449 - RNA, 62 nt, Pseudomonas aeruginosa PA01
cacuggccgcaucgcugaaggaacagcccgacgggcgcgccuucuucagccugcgcgccgug

SEQ ID NO: 59450 - RNA, 120 nt, Pseudomonas aeruginosa PA01
cacuucaugcagcaggccugugcgcagauccagcgcccggugugccggcuggcgccgggcaccuacccggcgcugcugagcaaccgcuggccgggcaacgugcgccaguugcagaacgug

SEQ ID NO: 59451 - RNA, 79 nt, Pseudomonas aeruginosa PA01
auuucauggaggcgagcgguucgcgggaaaggucgcgagcaacgcaccuucggaccgacccucgcugcguccaugaagu

SEQ ID NO: 59452 - RNA, 104 nt, Pseudomonas aeruginosa PA01
caacugguccaugaucauccggaagugcugcauagcucacguuucucccgguucucccuggcgcucgcgguacggagccggcccugccgguugaggaucaguug

SEQ ID NO: 59453 - RNA, 57 nt, Pseudomonas aeruginosa PA01
caacugcgcgacgccgcggucggacgcuuccugggucagcgccggaucgugcaguug

SEQ ID NO: 59454 - RNA, 130 nt, Pseudomonas aeruginosa PA01
caagcccucgcagcucuccggcggccagcagcagcggguggccaugggccgggcgcuggcgcggcggcccaaggucuaccuguucgacgagccgcuguccaaccucgaugccaagcugcggguggaaaug

SEQ ID NO: 59455 - RNA, 130 nt, Pseudomonas aeruginosa PA01
caagcgccucggcguuucgcauaccacggcggcgaacaagcugcgccagcauggcguggggcaaagcgagggcugagcggcaugcuugccgguuuguugcaggcugggaaagaaacgguggaggcgucgg

SEQ ID NO: 59456 - RNA, 112 nt, Pseudomonas aeruginosa PA01
aucucgcgcugcuggaagacccgggucugcuggacgccgccgacaugcugaucgaccagggcgucggcgccgcccacgccuggcaccgggcgauccaggcccagugcgagau

SEQ ID NO: 59457 - RNA, 95 nt, Pseudomonas aeruginosa PA01
aucgacaaccgcgcccucagccugcugcucgccuacgcccagggcggccacacgcucagcgccggcuggcagcggaugaacggcgccagcucgau

SEQ ID NO: 59458 - RNA, 65 nt, Pseudomonas aeruginosa PA01
auccgcacgaucagguugaggcggcccggaucguuguccggguugagaauaucgaucaggcggau

SEQ ID NO: 59459 - RNA, 61 nt, Pseudomonas aeruginosa PA01
augccgaccuggcugcuggcggggccgggaaggaacuggcagagggcgaccaggucggcgu

SEQ ID NO: 59460 - RNA, 70 nt, Pseudomonas aeruginosa PA01
augccgcaggcauuggaagugucgguugaagauauaacgcgagccacauccaguugcaugccauaggcau

SEQ ID NO: 59461 - RNA, 56 nt, Pseudomonas aeruginosa PA01
augaccgacggccccgccgacuacaucgacgagaugcuccggcugaucgucggcau

SEQ ID NO: 59462 - RNA, 68 nt, Pseudomonas aeruginosa PA01
auguucuccugcggcaugggugcguucaucgccggcaacgacggacgcacuucgcugcgggucggcau

SEQ ID NO: 59463 - RNA, 55 nt, Pseudomonas aeruginosa PA01
augucuuauguucggcgucgcgcuguauucauuuggccggcaucuuauggggcgu

SEQ ID NO: 59464 - RNA, 59 nt, Pseudomonas aeruginosa PA01
augccugggcagcacguagagcugggccagcaccagcggcagcucgcgguugccggcau

SEQ ID NO: 59465 - RNA, 59 nt, Pseudomonas aeruginosa PA01
augcgcgacgcggggauggacguggaggccuaucucuacgccaucugagugcucgccau

SEQ ID NO: 59466 - RNA, 63 nt, Pseudomonas aeruginosa PA01
auggcgcguuguccucgccgccguugcgcgaagguacgugauucguggcaggggaugcgccgu

SEQ ID NO: 59467 - RNA, 71 nt, Pseudomonas aeruginosa PA01
cccgaagaggcuauccgucgcgccgcuaccauccugcaacagcagcuggcagcguucguggaccucaaggg

SEQ ID NO: 59468 - RNA, 56 nt, Pseudomonas aeruginosa PA01
cccgacauucugcgccuaaguucgaaauccgcucaagcgcggcgccgaauaucggg

SEQ ID NO: 59469 - RNA, 78 nt, Pseudomonas aeruginosa PA01
cccccagcgcugcagucggcaacuggcucuggcgccagggcagcgccgauagggaaggagugccgacggccugguggg

SEQ ID NO: 59470 - RNA, 73 nt, Pseudomonas aeruginosa PA01
cccagggcgcggucgccgggguccagcuggcccacgccgggcgcaaggcgaguaccuggcggccguggcuggg

SEQ ID NO: 59471 - RNA, 58 nt, Pseudomonas aeruginosa PA01
cccaguccggcgcauacggcgcgcaccugcucggcauggcgcgccagcgccgccuggg

SEQ ID NO: 59472 - RNA, 57 nt, Pseudomonas aeruginosa PA01
cccagcucgacaucccggcgcuguggcaggccuucggucgcgccgggcugcccuggg

SEQ ID NO: 59473 - RNA, 107 nt, Pseudomonas aeruginosa PA01
ccaggccagcggccggcugugcaucggggugacgccuuggguggcgcugaccuuccucucggaggcggugcaggcguuccgcgagcgcaugccggaggugcgccugg

SEQ ID NO: 59474 - RNA, 55 nt, Pseudomonas aeruginosa PA01
ccaggccgccgacguagcgaucggagccgaucacgcugcgcaucuccgcggccgg

SEQ ID NO: 59475 - RNA, 56 nt, Pseudomonas aeruginosa PA01
ccaggccgcucagggucaacggauacaucuguuccuugaccaguucgcggaccagg

SEQ ID NO: 59476 - RNA, 65 nt, Pseudomonas aeruginosa PA01
ccaggcgaucggugccggaguugugcucggcacgcgucagcagcgccucggcgccgaaccccugg

SEQ ID NO: 59477 - RNA, 130 nt, Pseudomonas aeruginosa PA01
ccaggcgcugccgucggcggaccugaucguccugcccggcucgaagagcgugcgcgccgaccucgcggcgcugcgcgagcguggcugggacgaggcgauccuccgucaccugcgcuacggcggucgccug

SEQ ID NO: 59478 - RNA, 96 nt, Pseudomonas aeruginosa PA01
ccagcucgguguugaagcgagugucgccgccgacgcccuucuuggucacgauguugaugaucccgccgguggcgccgccgccguacaccgcgcugg

SEQ ID NO: 59479 - RNA, 78 nt, Pseudomonas aeruginosa PA01
ccaggcuggccaccggcucggcgacgccgagguacuggccgaggugcacgcggcggaugccgagcuggccggagaagg

SEQ ID NO: 59480 - RNA, 56 nt, Pseudomonas aeruginosa PA01
ccagggcacgcugggcgucggcaucgacgccuucgcccagcucggcgugcgccugg

SEQ ID NO: 59481 - RNA, 56 nt, Pseudomonas aeruginosa PA01
ccagggcaucgagacuuccggccacuaugacuucgccgcucucgauccgcgccugg

SEQ ID NO: 59482 - RNA, 99 nt, Pseudomonas aeruginosa PA01
ccaguugcaacaccguggcguucuauuuccacgagcgugucuggcagcgcuucggcgcccggccgcgccgggagagcggacacggccacggcaaucugg

SEQ ID NO: 59483 - RNA, 71 nt, Pseudomonas aeruginosa PA01
ccaggcuccgcgcggugccgagggcggcaucgaagguuucgcggcuauguucggcgaagcgcgggcgcugg

SEQ ID NO: 59484 - RNA, 80 nt, Pseudomonas aeruginosa PA01
ccaucuggucggccuggccgaggugcuggcgauguaccugcuggucuggucgccggcgcccuggcgccuggucaggcugg

SEQ ID NO: 59485 - RNA, 116 nt, Pseudomonas aeruginosa PA01
ccacgagcugcgcacgccgcuggcgcgccugcagguggcggcagagggcacgcuguccgcgcagcuccugcgcgagcgccuggagcaggagguacagggcaugcagcaacuggugg

SEQ ID NO: 59486 - RNA, 78 nt, Pseudomonas aeruginosa PA01
ccagcaccguggcgagcaggcggucggcgccguaccaggccucggcgccgaacaggucgcgcucggcgaguugccagg

SEQ ID NO: 59487 - RNA, 69 nt, Pseudomonas aeruginosa PA01
ccagcacuuucucggccuuacccuggcggaucaugcucgcugccaggcgcagguugagcaggaagcugg

SEQ ID NO: 59488 - RNA, 71 nt, Pseudomonas aeruginosa PA01
ccagcagcagcaagcugcacagcgccgcgccaagcaucugccggcgcccggcgaacagcuugcgcucgcgg

SEQ ID NO: 59489 - RNA, 75 nt, Pseudomonas aeruginosa PA01
ccagcacucggcccggcugcugcgggucggccuuguacagcaccaguucggccucggcaucgucccagguggugg

SEQ ID NO: 59490 - RNA, 95 nt, Pseudomonas aeruginosa PA01
ccagccguaguaguuguccgcuccgcucuuggcgccgcccaccgcauggucggccaguugcgcaccaagcuggcgggcgagcaccucgacggcgg

SEQ ID NO: 59491 - RNA, 65 nt, Pseudomonas aeruginosa PA01
ccagcgccgacgggcucgacaugagcuucucgccuauggucgacaucacccgcgacgcgcgcugg

SEQ ID NO: 59492 - RNA, 71 nt, Pseudomonas aeruginosa PA01
ccagcgccgccccggacaggcccggagcgugcucguugacgugcaggcuggcgucuuccagggccgacugg

SEQ ID NO: 59493 - RNA, 56 nt, Pseudomonas aeruginosa PA01
ccagccagccuucgccgaggcucggugcgcgcacccagagcugcgacggcuggugg

SEQ ID NO: 59494 - RNA, 63 nt, Pseudomonas aeruginosa PA01
ccagcaggaaccgcgcgcgguucuccaggcuaccgccauaggcaucgcugcgccgguugcugg

SEQ ID NO: 59495 - RNA, 87 nt, Pseudomonas aeruginosa PA01
ccacgucguagucgguuucgcccagcucggugccgauggccagcaccacgucggccucgguggccagcucgcguaccggcacgcagg

SEQ ID NO: 59496 - RNA, 103 nt, Pseudomonas aeruginosa PA01
ccacuacuaccaaccgggcuggacccuggucgguggcggcgccuacgcacagggcgacaccgcgcggccgauggccgggcuggucccgcccggcguggagugg

SEQ ID NO: 59497 - RNA, 99 nt, Pseudomonas aeruginosa PA01
ccaccugccggccuuccuccagcuccagcagcccggcgccgagcgccaccaggcacggcaggcccuugcugcgggcgaggauggccacgugggaggugg

SEQ ID NO: 59498 - RNA, 113 nt, Pseudomonas aeruginosa PA01
ccaccugguggacggccgcggcaccgaccugcugcccggggcgccggaccugcaggagcuggccaagguguuccugcgccugcgcccgcuggcggaacacgugguccaggugg

SEQ ID NO: 59499 - RNA, 56 nt, Pseudomonas aeruginosa PA01
ccacgagccggagcuggccuuccgcaucggcggcaaggucauccgccggcuggugg

SEQ ID NO: 59500 - RNA, 85 nt, Pseudomonas aeruginosa PA01
caugggccuggccguucccggcaccggucuggcggucauggcgagcguggcccgcgagcguuccgggauggccucggcgaccaug

SEQ ID NO: 59501 - RNA, 55 nt, Pseudomonas aeruginosa PA01
cagcaacugcuccgccgcgcgccggccgauggcuucgcgcggggugcggaugcug

SEQ ID NO: 59502 - RNA, 130 nt, Pseudomonas aeruginosa PA01
cagcaggccgccgaggcugaccuccaggccgccccggcugcucagcgugcccuugccgcuguuguccaggcugcgcgcccgcaggucgaggcgguuggcugcggagaacaagccgaggcgguugucgaug

SEQ ID NO: 59503 - RNA, 61 nt, Pseudomonas aeruginosa PA01
cagcaggcgaucgagcaugccgcccugcuccagcaggcggcgggcgacgaucacccgcaug

SEQ ID NO: 59504 - RNA, 91 nt, Pseudomonas aeruginosa PA01
cagccgcagcucgaggccacugcaaucggugcuggugcgcgcgguggcguucuuccucggcgccagcgccggcaugucgcugcugccgcug

SEQ ID NO: 59505 - RNA, 61 nt, Pseudomonas aeruginosa PA01
cagccagcccggcggucuccgcgaacccgcuccgacgcggccggcgcgccaggucuggcug

SEQ ID NO: 59506 - RNA, 65 nt, Pseudomonas aeruginosa PA01
cagcggagagacuuuuucauuaaaauucuugucgaaauaaugaauauucggaagucuccccccug

SEQ ID NO: 59507 - RNA, 70 nt, Pseudomonas aeruginosa PA01
cagcggcagcaacgccagucccuggccgcgcagggcggcgucgcgcauggccuggccguuguugcugcug

SEQ ID NO: 59508 - RNA, 130 nt, Pseudomonas aeruginosa PA01
cagcggcggccugucgcugauguucgcccgggucgcccugggcgcggcggaagcgccgcuguuccccuccggcggcaagcucaacucgcuguggcugggcuccagcgaacgcagccgcggcgccgugcug

SEQ ID NO: 59509 - RNA, 85 nt, Pseudomonas aeruginosa PA01
cagcguccagcauuccuggaccggccaggagcaaugggugguccaccaccugacccuggccggccacgaccugcucgaccgccug

SEQ ID NO: 59510 - RNA, 126 nt, Pseudomonas aeruginosa PA01
cagcgugcccacuacgucgagggccggcguaucgccgagcguccggugcugcucgagcugggugccgaacuggggcuuggcgagggcuucgccgaggcguucgacgccugcuccggcgagccgcug

SEQ ID NO: 59511 - RNA, 62 nt, Pseudomonas aeruginosa PA01
cagcucgccaccggcaagcccugggcacugaacacgauggcgcgggagcugguggugcccug

SEQ ID NO: 59512 - RNA, 72 nt, Pseudomonas aeruginosa PA01
cagcucggccggcagcucguaggcauuggcuucgacgaaacgcggcugaugcggcgagcgcucggccaguug

SEQ ID NO: 59513 - RNA, 58 nt, Pseudomonas aeruginosa PA01
cagcgccuugcgcgcgcgucugcuggguucgccgcgggagggcgccagcgaggugccg

SEQ ID NO: 59514 - RNA, 55 nt, Pseudomonas aeruginosa PA01
cagcgccaccccgaggaucgccggcucguccggcggacgcccgguguaggugcug

SEQ ID NO: 59515 - RNA, 60 nt, Pseudomonas aeruginosa PA01
cagccgcucgccgaccccgaccugugcaaacgccugcaggccgcccuggucgagcagcug

SEQ ID NO: 59516 - RNA, 84 nt, Pseudomonas aeruginosa PA01
cagccggggaacugcccggcggcacgcugggccugcagcgaaaacgccgcggccggacgcucgccgggcaggccgagcaggcug

SEQ ID NO: 59517 - RNA, 58 nt, Pseudomonas aeruginosa PA01
cagccugaaggacuggccggcggcggacugcgccaccaggcagcuguucuucaggcug

SEQ ID NO: 59518 - RNA, 78 nt, Pseudomonas aeruginosa PA01
cagcgacucgacguccgggaucaccccgucgcugccgaugugccccucggcggcggcguucuggaucggcgacagcgg

SEQ ID NO: 59519 - RNA, 58 nt, Pseudomonas aeruginosa PA01
cagcgagaaggaacaguuggcgaucuaccgcgagcagcucagugccuuccacccgcug

SEQ ID NO: 59520 - RNA, 79 nt, Pseudomonas aeruginosa PA01
cagcgagccgcacacgcccagcagcgaugcgcccagcagcaacuggcggugcgggcgggugcgggccaggcggccgcug

SEQ ID NO: 59521 - RNA, 97 nt, Pseudomonas aeruginosa PA01
caggucgcugcccucggucgcccguugcaucggcucgcguucgucgugguuaccggcgaaccagcgcaacggcgcguccaggggggcgcucaaccug

SEQ ID NO: 59522 - RNA, 60 nt, Pseudomonas aeruginosa PA01
caggucggcacgccgcuggcgcgcuccggcaacaccggcaacagcagcgggccgcaccug

SEQ ID NO: 59523 - RNA, 104 nt, Pseudomonas aeruginosa PA01
cagggacagggcgcgcggcgcgaaggacggccgcggguugacggaacgggagcuguucauaggcuuucuggcucuucuucguugaucggcgaguccuggcucug

SEQ ID NO: 59524 - RNA, 108 nt, Pseudomonas aeruginosa PA01
cagggccugggccagcucgcggcuggcgggcauccgcgugcggcugccgaggcggccgucgaggauccguucgcgcagcgcggcguagagcuggcgggccaggcccug

SEQ ID NO: 59525 - RNA, 67 nt, Pseudomonas aeruginosa PA01
caggccgaccaggaacgcggugaucgucugugguugcagguccaugugccgcgccugcucggcacug

SEQ ID NO: 59526 - RNA, 73 nt, Pseudomonas aeruginosa PA01
caggccgagccagccgcgccaggccaggcgcuggccgaacagcgcccagcccauggcgacgguggcgaggaug

SEQ ID NO: 59527 - RNA, 65 nt, Pseudomonas aeruginosa PA01
caggccggcgcgcuccugcagacccgccguuaccggcggcucaugcguucgcgcgccgaagccug

SEQ ID NO: 59528 - RNA, 68 nt, Pseudomonas aeruginosa PA01
caggccuguagcgccgaggcggccacuucgcgcaaggcggugucgucgggccgcucggccagcgccug

SEQ ID NO: 59529 - RNA, 60 nt, Pseudomonas aeruginosa PA01
caggcgcuggcgcaacgcaccgaaggccucgauccgcgccuggugccggcgcugcaccug

SEQ ID NO: 59530 - RNA, 74 nt, Pseudomonas aeruginosa PA01
caggcggaggccgguguaccggugaaggaacugugucgccgacacggcuucagugaugccucguucuacaccug

SEQ ID NO: 59531 - RNA, 81 nt, Pseudomonas aeruginosa PA01
caggccagccgcauccugcgccuggugguggcgcacggcgacccguggcagaaggccgaggcgcgcgaguugcuggcacug

SEQ ID NO: 59532 - RNA, 105 nt, Pseudomonas aeruginosa PA01
cagcuuucgucgugguuauagccgcugguggugcagcccaggcaacggacgaaggcuuccuugcccggaucgaccaccagcgccuggccggccuugccgacgcug

SEQ ID NO: 59533 - RNA, 59 nt, Pseudomonas aeruginosa PA01
cagcuggagcagaugaaagccuaugcggacgacgucgaaggccauguccugcccggcug

SEQ ID NO: 59534 - RNA, 70 nt, Pseudomonas aeruginosa PA01
caguccgaucggccugcgccacgauccgcgcgagacccagcggaugcgccgcgaagggcugaucgcgcug

SEQ ID NO: 59535 - RNA, 129 nt, Pseudomonas aeruginosa PA01
caggucuucggcgcuggcgccgagcccgaccaggcgugcggccuggcugaacgacagcguggucggaucgcgcugcuccaggcgcgcgacccggucgggaagcggcgcgaguugcuugccgagguccug

SEQ ID NO: 59536 - RNA, 112 nt, Pseudomonas aeruginosa PA01
cagguguacgccgacgcgcugggcgccccauacggagaucgccgcgucggugaccuccagcagcaggcgcgcgcgguucucgauggagccgccguagcggucggugcgcuug

SEQ ID NO: 59537 - RNA, 64 nt, Pseudomonas aeruginosa PA01
cauaagcccuggagaucccguuggugcuugaaagguguaacgggcgaggguaccgggagcuaug

SEQ ID NO: 59538 - RNA, 66 nt, Pseudomonas aeruginosa PA01
caguugcccggccauguccuccagcgaccagagcaccuguugcggaucgucguagccgagcaucug

SEQ ID NO: 59539 - RNA, 116 nt, Pseudomonas aeruginosa PA01
caucggagcgcacacaggcaaggcgggccccgcuggacggggccucguugaagguucagaagcugaagucgaccuugguccagaagguccggcccggcucuggaaccguuucguug

SEQ ID NO: 59540 - RNA, 85 nt, Pseudomonas aeruginosa PA01
caucguuccgcagcucuggcacgucggcagcguccggcgccugggcguggagccggacgccagcgugcccggcuacggcccgaug

SEQ ID NO: 59541 - RNA, 64 nt, Pseudomonas aeruginosa PA01
caucgcccggcgcacccaccggcugaccgcgauccucgccgccggccuggagcgccugggcgug

SEQ ID NO: 59542 - RNA, 130 nt, Pseudomonas aeruginosa PA01
caugaccggcuggcgccugggcuggcugguggcgccgacagcggcggugccugaacuggagaagcuggcgcagaaccucuacaucagcgcgccgagcauggcccagcaggccgcgcuggccuguuucgag

SEQ ID NO: 59543 - RNA, 109 nt, Pseudomonas aeruginosa PA01
caucaccucgagguuggcgaacaugcccggcagcagcuugccguccggguucuccagggcagcgcggaccugcagguugcgggucucguugucgaccuugggguugaug

SEQ ID NO: 59544 - RNA, 88 nt, Staphylococcus aureus subsp. aureus Mu50
caucaaugucauggacagaaauaugauguaauuguuguucgauuguugaaaaauaaucuauauuaucuuucgucaauugaauuugaug

SEQ ID NO: 59545 - RNA, 61 nt, Staphylococcus aureus subsp. aureus Mu50
cauaucauuaauugcacuaccaaugauuauuguuaauagcguugguacggcgauuuuuaug

SEQ ID NO: 59546 - RNA, 93 nt, Staphylococcus aureus subsp. aureus Mu50
caguguuaauaguuaauuucacauuuggauauuuacgaacgauuucagcguucagauccagucgauguggauuggcauuaauuucuaauacug

SEQ ID NO: 59547 - RNA, 58 nt, Staphylococcus aureus subsp. aureus Mu50
cauauagcguucucgcauaaguagguuuauuaaucugcaaauguugagcgcauauuug

SEQ ID NO: 59548 - RNA, 75 nt, Staphylococcus aureus subsp. aureus Mu50
ccagauaaaauuauggauacacugauuaauuaucauucccuagauauucaaugggguaaucaugaugugcuuugg

SEQ ID NO: 59549 - RNA, 79 nt, Staphylococcus aureus subsp. aureus Mu50
ccaucacgauuugggaggaaauuuuauuggaccuucaagagcgcgguuugaaaaauguccuccuguucaucacggaugg

SEQ ID NO: 59550 - RNA, 56 nt, Staphylococcus aureus subsp. aureus Mu50
auguaucucuauauuuacugaaguuucaauucggucuaauuuuauagaaggugcau

SEQ ID NO: 59551 - RNA, 55 nt, Staphylococcus aureus subsp. aureus Mu50
auguucaucuacaguauuauguguauaaggcaaaguuggauuuguagaugaaggu

SEQ ID NO: 59552 - RNA, 113 nt, Staphylococcus aureus subsp. aureus Mu50
augugucaauaauacguucgacuugggcaucgcuuaaaugguuuugauuuuuuccuuuuucaaaaucauuggaugcaucgauaaauaauacguugucgucuuguuggcaacau

SEQ ID NO: 59553 - RNA, 107 nt, Staphylococcus aureus subsp. aureus Mu50
auuagguuuauaauauuaaaagcaugauacucaauaaaauuggaacacgaaauggugaacuaaauugaaugagugucaugcuuaauuuauguguugugauauauagu

SEQ ID NO: 59554 - RNA, 69 nt, Staphylococcus aureus subsp. aureus Mu50
auucagaccgaaaagaaagcauaugcaacuucaagagugaaggggcauaugcuucuuuuucaauugagu

SEQ ID NO: 59555 - RNA, 106 nt, Staphylococcus aureus subsp. aureus Mu50
aucuucugguucuuuaccuaaugauuuugguacgauacugaauguauuugaaauaccaucuuuacagcaaucguaagggaucuuagcuacagaacuuaaugaagau

SEQ ID NO: 59556 - RNA, 75 nt, Staphylococcus aureus subsp. aureus Mu50
augccguauguuauaugagacggggucauuucuugaauuaagagaagaaacaauugucuuauugaaaacuggcau

SEQ ID NO: 59557 - RNA, 68 nt, Staphylococcus aureus subsp. aureus Mu50
augauaauacaagauagacaacuuucuauacucuaauauagugaguugaaguagcuugucauaaucau

SEQ ID NO: 59558 - RNA, 73 nt, Staphylococcus aureus subsp. aureus Mu50
aucgauuagcaacaauuguaaaguuugaaaugucucaaaaggcauauucaacugacguuguuuguuaaucgau

SEQ ID NO: 59559 - RNA, 60 nt, Staphylococcus aureus subsp. aureus Mu50
aucauucaaaccuaaguaagcuuccguuuccacgauguagccuguauacguuugaguggu

SEQ ID NO: 59560 - RNA, 88 nt, Staphylococcus aureus subsp. aureus Mu50
auauaagaaauccaccuacgauucgaaauagguaucuuaaagcauaucucaagauauccauuaugauguagauggacaguuuuuauau

SEQ ID NO: 59561 - RNA, 89 nt, Staphylococcus aureus subsp. aureus Mu50
cacauaaaaauuuaucaucaacaauuggugaaccuaaugccaaugcauaugcuucgggcugguuuaccaauaaugaugaacauuuagug

SEQ ID NO: 59562 - RNA, 87 nt, Staphylococcus aureus subsp. aureus Mu50
cacauaaaguaucaccaguaccuguaucuuuaagaccuaccgcagccgcgauaucuccagaguauacaguaucgauuucuugacgug

SEQ ID NO: 59563 - RNA, 68 nt, Staphylococcus aureus subsp. aureus Mu50
caauugacauuacgacagcacuuguuguaucaaauguaacgacacgaucugcuguuguaggucccuug

SEQ ID NO: 59564 - RNA, 66 nt, Staphylococcus aureus subsp. aureus Mu50
auuugaaaggagccgauaaugguguuaucaauuagaagucaaaucauuauuggcgucguuucgagu

SEQ ID NO: 59565 - RNA, 67 nt, Staphylococcus aureus subsp. aureus Mu50
auuugucuuugcacuguucacuggaguacugcaaaguauuucaucagauugguacgaagcagcagau

SEQ ID NO: 59566 - RNA, 55 nt, Staphylococcus aureus subsp. aureus Mu50
auuuugaugagcgugcaauacuuaauaguaauugagcguaugccgcuuucgaaau

SEQ ID NO: 59567 - RNA, 56 nt, Staphylococcus aureus subsp. aureus Mu50
caaaguaauguaugaaguugugguaacacauaaacgugauucauaucauuacuuug

SEQ ID NO: 59568 - RNA, 69 nt, Staphylococcus aureus subsp. aureus Mu50
aggaaaucaugacuuaugugugagugaacgaucaucuauacauccguucacuucaucucaugacuuucu

SEQ ID NO: 59569 - RNA, 76 nt, Staphylococcus aureus subsp. aureus Mu50
aggaggacaacauagugaguuuguuacauauugcggugauauuaccguuaauauucgcacucauuauuccuauccu

SEQ ID NO: 59570 - RNA, 118 nt, Staphylococcus aureus subsp. aureus Mu50
aggaauuagaaaguuuagcagguguaggacguaaaacugcuaauguagucaugaguguagcauuugaugaaccuucauuagcuguugauacgcauguagaacguguuucuaaacgcuu

SEQ ID NO: 59571 - RNA, 57 nt, Staphylococcus aureus subsp. aureus Mu50
acuuaaaaaagcagugaaucauuucaauagauggaaugauuuuacugcuuuuugugu

SEQ ID NO: 59572 - RNA, 130 nt, Staphylococcus aureus subsp. aureus Mu50
agauguuguagacuuauacauucaauacccagauauuguagauaaauuagcguuguuaaaaggucaagaauaugaaauugcaacaauuaaugaucuuacagaagcuuuugaagcagaccugucuacaucu

SEQ ID NO: 59573 - RNA, 79 nt, Staphylococcus aureus subsp. aureus Mu50
agugaaccauaacuuaaaagucacaauacacaugacuaaaaaugucugugcuauuguggcuuuuuuaaauugguugauu

SEQ ID NO: 59574 - RNA, 65 nt, Staphylococcus aureus subsp. aureus Mu50
acaucuaacaguaaacauuuaggcaguauaguuuaaaaucacugcgcaaugauacugucagacgu

SEQ ID NO: 59575 - RNA, 59 nt, Staphylococcus aureus subsp. aureus Mu50
accagcuaaauuacuaccuucagucaacgucccuguuacugauacaguguuugacuggu

SEQ ID NO: 59576 - RNA, 59 nt, Staphylococcus aureus subsp. aureus Mu50
accagcuacaguaguugcauuuuguacuuguuguuuuaaugcaucuuucugugcuuggu

SEQ ID NO: 59577 - RNA, 98 nt, Staphylococcus aureus subsp. aureus Mu50
aauguagauguucuuuagacauuaaaagcuucuaacaugauacggaauaugagguuccuguaucacauuagaagcuuuuuuguugcggugcuuauauu

SEQ ID NO: 59578 - RNA, 78 nt, Staphylococcus aureus subsp. aureus Mu50
aauauuguauaaauagagaagagcaguaagacgguaucuaauugaaaaugaucuuacugcucuuuuauauacuuuauu

SEQ ID NO: 59579 - RNA, 60 nt, Staphylococcus aureus subsp. aureus Mu50
aaucaaauuauauugagccguuugaaucaaaauuggaugugucgguaaauugauuugauu

SEQ ID NO: 59580 - RNA, 107 nt, Staphylococcus aureus subsp. aureus Mu50
aaucaccggugcaaaguauuauuuguuauuuagcuuugcaucguuuacauaaagugccuaugaugauggaagguaaauggcaaaguacuauacaucgucaauugauu

SEQ ID NO: 59581 - RNA, 59 nt, Staphylococcus aureus subsp. aureus Mu50
aaucacuagagcuaugaaacuuggugcuaaagguaucaaaacucaaguaucuggucguu

SEQ ID NO: 59582 - RNA, 72 nt, Staphylococcus aureus subsp. aureus Mu50
aaugcaaguuggggugggacgacgaaauaaauuuugcgaaaauaucauuucugucccacucccauuggcauu

SEQ ID NO: 59583 - RNA, 67 nt, Staphylococcus aureus subsp. aureus Mu50
aauugcaucauuuaaagcugcuucagaaguagaagguauaaacugguuggaguuagauguugcaauu

SEQ ID NO: 59584 - RNA, 61 nt, Staphylococcus aureus subsp. aureus Mu50
aauucuacaucaauccuacaggacgcuuuguaaucgguggaccucaaggugaugcaggauu

SEQ ID NO: 59585 - RNA, 101 nt, Staphylococcus aureus subsp. aureus Mu50
aauuggcauggcguuaaauauuacugguuccaguuuuuuguggccuuuaaauacaauuuauaugaaacaagaacuuggaaaaaguuuaacuguugcugguu

SEQ ID NO: 59586 - RNA, 87 nt, Staphylococcus aureus subsp. aureus Mu50
acguguuuccauuguugauacaaacauuuucaauaauugauucgcuucauauugugaaguuugaaacuguucaacuaugggcaaugu

SEQ ID NO: 59587 - RNA, 68 nt, Staphylococcus aureus subsp. aureus Mu50
aacacguugcagcacgugauucuggugcagcuauuacagcuaagcacagaggucguguugaacauguu

SEQ ID NO: 59588 - RNA, 70 nt, Staphylococcus aureus subsp. aureus Mu50
aacaacuucaugguuaaauugcacuguagcauuuggaugugcuucaaugcuuuuagccauuuuacguguu

SEQ ID NO: 59589 - RNA, 82 nt, Staphylococcus aureus subsp. aureus Mu50
aacauucccuuaauaauaaguauggucgugagccccucccaagcucgcggccuuuuuuauuguaauaaagaaggggagaguu

SEQ ID NO: 59590 - RNA, 79 nt, Staphylococcus aureus subsp. aureus Mu50
aaauggauacaguuuagugcgcaaauuaauuaaugaaucaggcauugauuuggcaucaaacuucgauaaucguccauuu

SEQ ID NO: 59591 - RNA, 55 nt, Staphylococcus aureus subsp. aureus Mu50
aaagcucucuucauaaucauguuguaguuuuuguugacaugaugaagagaguuuu

SEQ ID NO: 59592 - RNA, 59 nt, Staphylococcus aureus subsp. aureus Mu50
aaagacuuggucgaaucguggaugauauauuaucaaacgcacggcucgaacaagucuuu

SEQ ID NO: 59593 - RNA, 66 nt, Staphylococcus aureus subsp. aureus Mu50
aaaagaugguaacuauuauauggaagguaucuuagaugauauacaaccagaugguuaugguuuuuu

SEQ ID NO: 59594 - RNA, 67 nt, Staphylococcus aureus subsp. aureus Mu50
aaaacagcuuaaugauguaaugaaauuagugaguuaaucacugacuucaacgucauugagcuguuuu

SEQ ID NO: 59595 - RNA, 55 nt, Staphylococcus aureus subsp. aureus Mu50
aauacggcacuucuucaaaauuuuauagcgguuuugauaaggggaguguaguauu

SEQ ID NO: 59596 - RNA, 62 nt, Staphylococcus aureus subsp. aureus Mu50
aauacacuaaucgcacguacucacccuuuauuacagugauacggucauacgauuaguguguu

SEQ ID NO: 59597 - RNA, 81 nt, Staphylococcus aureus subsp. aureus Mu50
aauaauuugauugauuaugacuucggaauugauuuugcagaaagagcaaucaaaaaugaagacauaguuaauaaaaauguu

SEQ ID NO: 59598 - RNA, 129 nt, Staphylococcus aureus subsp. aureus Mu50
aagcuucagcaguuaauucaguuguaauugguuuuccuaauaauugugaauaugcaaguaaacguguuaaugcaccuucuaauucacgaauauuagauugaauuugauuugcuauauaauuuaaagcuu

SEQ ID NO: 59599 - RNA, 67 nt, Staphylococcus aureus subsp. aureus Mu50
gaagaagacuuauuuacugcguuugcugaagauaaugcacaagcaaaugcguuuacaagcuuugauc

SEQ ID NO: 59600 - RNA, 57 nt, Staphylococcus aureus subsp. aureus Mu50
gaaaugccccuuucgaaguagacauugaaaaaaugaaaacuuugaagggagcauuuc

SEQ ID NO: 59601 - RNA, 87 nt, Staphylococcus aureus subsp. aureus Mu50
gaaauaaugcagagguucaacuaggugcugauaaagcugcuaucuuugaugcacauuuauuaguuuuagaugacccugaauuaauuc

SEQ ID NO: 59602 - RNA, 56 nt, Staphylococcus aureus subsp. aureus Mu50
gaaaagcuccaaucaaaguugacgcucaaauaguuuaacuuugaucggagcuuuuu

SEQ ID NO: 59603 - RNA, 101 nt, Staphylococcus aureus subsp. aureus Mu50
gaaagcucccaagaguuaauuaaugaagcuguaaacuuauuggugaaaaguaaguaauggauauuguuaauauaguuaucauguuacucauugggguauuc

SEQ ID NO: 59604 - RNA, 67 nt, Staphylococcus aureus subsp. aureus Mu50
gaagaguuugaaugauaacucauugcauuuaaagauaaauggcaugcguuaugauuuaaagcucuuc

SEQ ID NO: 59605 - RNA, 59 nt, Staphylococcus aureus subsp. aureus Mu50
gaaggugguaauaacguuauuaaauuaaguacaggugaugacguuguugaauuaucuuc

SEQ ID NO: 59606 - RNA, 106 nt, Staphylococcus aureus subsp. aureus Mu50
cuucgaccugcagggauuauuuuuugugaaaaugaacguauugaugcuguuucagauggcaacuuuauuuuacgcaauaaaacggugaaaauccuugaaguugaag

SEQ ID NO: 59607 - RNA, 67 nt, Staphylococcus aureus subsp. aureus Mu50
gaauuagcuuuuucacauaucauaggucugaugcagacauugaaauuguugaagaagacuuugauuu

SEQ ID NO: 59608 - RNA, 102 nt, Staphylococcus aureus subsp. aureus Mu50
gacagucagguuuaaguuuaaaagcuuuaauuacuuuagccauugcuaccuucguugaaggugccugaucuguaauuaccuuuugagguuuaccaaauuguu

SEQ ID NO: 59609 - RNA, 60 nt, Staphylococcus aureus subsp. aureus Mu50
gagauuuucgaagcacguaacccuaaaggucaagcgguaauuacggaaaucgaagguguc

SEQ ID NO: 59610 - RNA, 66 nt, Staphylococcus aureus subsp. aureus Mu50
cugcaaauguuacaccuguuucuucgccaggacgguugacugagaaacuugguguacguuuuaaag

SEQ ID NO: 59611 - RNA, 55 nt, Staphylococcus aureus subsp. aureus Mu50
cuguuguuggauuaauguaugcauuugcgucacguuucagcguuccauucagcag

SEQ ID NO: 59612 - RNA, 89 nt, Staphylococcus aureus subsp. aureus Mu50
cuuaccauauagacauuuuguugugguuggauuucuaaaguuuuaaggucaccuuuuuccaacuucucaguaaauugauuauauguaag

SEQ ID NO: 59613 - RNA, 80 nt, Staphylococcus aureus subsp. aureus Mu50
cuauaguuacaugagacaccaugguuaugcugaccguuuaguacucgauaaaaauaaacauguuguuucugaaacuacag

SEQ ID NO: 59614 - RNA, 57 nt, Staphylococcus aureus subsp. aureus Mu50
cuauaaauacaagugcauauggaauuaagcuaucaccguuugaacuuguauuuguag

SEQ ID NO: 59615 - RNA, 83 nt, Staphylococcus aureus subsp. aureus Mu50
cuaggaauuauuauuuaccacuuaaacaagcaaugguugacagguggcuuuuuagguguggauacauuuuuugugaucucugg

SEQ ID NO: 59616 - RNA, 76 nt, Staphylococcus aureus subsp. aureus Mu50
cuaacuauaugagugauuuaaaugacgcuauguuacuuauuaaagguaauuuaaauuuagauccuguagaaguuag

SEQ ID NO: 59617 - RNA, 104 nt, Staphylococcus aureus subsp. aureus Mu50
cguauagccauaguccgagcguuagaagcgucacaggcaauggguacggcuacaugagaaccaugcagaagugaaauuccugugagcuuugcuagagcuguucg

SEQ ID NO: 59618 - RNA, 72 nt, Staphylococcus aureus subsp. aureus Mu50
cgacgcaaguaccuauuguaaaugggccugcucaucaucagcaauuccaaaagccagaagguacgguguacg

SEQ ID NO: 59619 - RNA, 78 nt, Staphylococcus aureus subsp. aureus Mu50
cgaaaucuuuagacaaguauccuacugaaaaucuagaagaguuuuaugauaaagaaggauauagagauggagaauuug

SEQ ID NO: 59620 - RNA, 62 nt, Staphylococcus aureus subsp. aureus Mu50
ccgguucguaucuugauacucaucgaccaauauuucuugaaaguguugacgguaugauucgg

SEQ ID NO: 59621 - RNA, 65 nt, Staphylococcus aureus subsp. aureus Mu50
ccuaaggauaguaaauaugucguaacuuguacgcaugaaaguuauaacgaaguuauuaugcuagg

SEQ ID NO: 59622 - RNA, 65 nt, Staphylococcus aureus subsp. aureus Mu50
ccuacuucaucaagcaauuguuucguaccacuaaaugaagcgauuuuacuugaagauacaguugg

SEQ ID NO: 59623 - RNA, 80 nt, Staphylococcus aureus subsp. aureus Mu50
cgcuuauugagccaaauagcaauccaacaauuucuugauugaacccaucagcuaaugaaaugaagauugcacucaaggcg

SEQ ID NO: 59624 - RNA, 65 nt, Staphylococcus aureus subsp. aureus Mu50
gcacuauuuguuaauaaauccauuucagguucaacuguuugcccuaauggauucgguaacaaugc

SEQ ID NO: 59625 - RNA, 68 nt, Staphylococcus aureus subsp. aureus Mu50
gauugucguagcaggcuaugucauuacauuaaauugggguacauuuauuugggcuguaacgaacgguc

SEQ ID NO: 59626 - RNA, 60 nt, Staphylococcus aureus subsp. aureus Mu50
gauuaccgcugaaaauggaauuaaguccuuaaauacuugugaaauauucggcgguacuuc

SEQ ID NO: 59627 - RNA, 80 nt, Staphylococcus aureus subsp. aureus Mu50
gcaacuuuagguaaugucauguuugcuucuauuuauuuagcaacagauauuuuaaaugauauuuaugggcguagaguugc

SEQ ID NO: 59628 - RNA, 72 nt, Staphylococcus aureus subsp. aureus Mu50
gcaauucggaaaaaaucgauuggcguggcuucagugcuuguagguacguuaaucgguuuuggacuacucagc

SEQ ID NO: 59629 - RNA, 103 nt, Staphylococcus aureus subsp. aureus Mu50
gagccucuuuaccuugaaaaguaugaacaguaccaauggauuuaucgacccauugauuaauuuuuguacguucaauaucaauucuagucgguaguuguugcuu

SEQ ID NO: 59630 - RNA, 63 nt, Staphylococcus aureus subsp. aureus Mu50
gaucguuuaauugcugugcuugguggaguuacuccauuuuuaauugcaauugucauuaugauu

SEQ ID NO: 59631 - RNA, 83 nt, Staphylococcus aureus subsp. aureus Mu50
gaugaaguguuuguuggccguauacguagagaugauucauuagaaaauacuuuccauguaugguguacaucagacaauuuauu

SEQ ID NO: 59632 - RNA, 65 nt, Staphylococcus aureus subsp. aureus Mu50
gaugacauauuuuaauagugaauauauuuugagauauuaauauauuuaauguuaaggauguuguc

SEQ ID NO: 59633 - RNA, 66 nt, Staphylococcus aureus subsp. aureus Mu50
gccaaugggagugggacagaaaugauauuuucgcaaaauuuauuucgucgucccaccccaacuugc

SEQ ID NO: 59634 - RNA, 78 nt, Staphylococcus aureus subsp. aureus Mu50
gccgaaucaugucgcugugcaauuugacggaguguuuauaacauaucaaacauugaaugcacgcgcgaaugauuuagc

SEQ ID NO: 59635 - RNA, 64 nt, Staphylococcus aureus subsp. aureus Mu50
gcuuuauugaugaugucuuuaugcuccgcuucuauuucugccaaccaagcaucaucgauaaugc

SEQ ID NO: 59636 - RNA, 77 nt, Staphylococcus aureus subsp. aureus Mu50
gcuuggugucuucuuagcgguuuaugugaugauuuuaaucuauuuugaaauacuaacauugacuucucaccguuggc

SEQ ID NO: 59637 - RNA, 70 nt, Staphylococcus aureus subsp. aureus Mu50
gcuuccgguaauuaucaagugccauuuucgauuggguuauacaaucuagaaucgcaugauaauuuaaugc

SEQ ID NO: 59638 - RNA, 58 nt, Staphylococcus aureus subsp. aureus Mu50
ggagauauugguaaagcuuuugcaagaagguugcaaggguuuaauacuaauauucuuu

SEQ ID NO: 59639 - RNA, 65 nt, Staphylococcus aureus subsp. aureus Mu50
ggacguaagagauaaaauaaagagguacuagaauuaacuagugccucuuuuauuauuuaacgucu

SEQ ID NO: 59640 - RNA, 59 nt, Staphylococcus aureus subsp. aureus Mu50
ggacguauuuuuuaucacauugaaaacuugcagguguucgguggguaaaugauacgucu

SEQ ID NO: 59641 - RNA, 129 nt, Staphylococcus aureus subsp. aureus Mu50
gcuaaaaaauaaaaaagacauaaucaugauuguucuugaugagcacuccauaaagucagguuaaaaguccaacuuuugagaugcacauuaucauuucaugauuaugucuacuuuuuaauauuuuuaugc

SEQ ID NO: 59642 - RNA, 78 nt, Staphylococcus aureus subsp. aureus Mu50
gcuaaaucauucgcgcgugcauucaauguuugauauguuauaaacacuccgucaaauugcacagcgacaugauucggc

SEQ ID NO: 59643 - RNA, 72 nt, Staphylococcus aureus subsp. aureus Mu50
gcugguacagguuguuauguaucgauuucagaagauaaacgauauuuauuugaagcgguauauggugcuggc

SEQ ID NO: 59644 - RNA, 98 nt, Staphylococcus aureus subsp. aureus Mu50
gcugggacauuaaguucuuaggcaauguaaaaaagcugauuucuauuaauuauuugauggaaauuagcuuuuuugauauguauuuuauaauguacagc

SEQ ID NO: 59645 - RNA, 81 nt, Staphylococcus aureus subsp. aureus Mu50
gcgauuacuaaaugcuacaaacgcuugugcauuauuaucaagauuuaaugaugcuaagaauuuuaguaaguaaagacccgc

SEQ ID NO: 59646 - RNA, 92 nt, Staphylococcus aureus subsp. aureus Mu50
gcgacaucugugugacgauaaugauaagcgacaguuaauaauuugugauuuuuauuagccgcuucaaucaugcgaucacacucuuccgucgu

SEQ ID NO: 59647 - RNA, 81 nt, Staphylococcus aureus subsp. aureus Mu50
uaccaauuucagcacgacgauuaaauacaugauauguacauugaccccauguauauaaguuuuggugacugaauacuggug

SEQ ID NO: 59648 - RNA, 73 nt, Staphylococcus aureus subsp. aureus Mu50
uaaauugggauuaaaugauucuuuauugguacagugguggcauuggaugaaucauuuauuacauuuuaauuua

SEQ ID NO: 59649 - RNA, 83 nt, Staphylococcus aureus subsp. aureus Mu50
uaacaaaaugaugauaaacuaguauacauugugguaaaaguaguaaugaccaguuguuacuaguaauuaucagcauuugguua

SEQ ID NO: 59650 - RNA, 63 nt, Staphylococcus aureus subsp. aureus Mu50
uaaauagaaacagcaguaagaugauuucaaaugugaaagucauccuacugcuguuuuuauuug

SEQ ID NO: 59651 - RNA, 62 nt, Staphylococcus aureus subsp. aureus Mu50
guugauguugcuaacuucuuaacaaguaugggagcuaauauuaagggagcgggcacaucaac

SEQ ID NO: 59652 - RNA, 58 nt, Staphylococcus aureus subsp. aureus Mu50
guuggggugggacaacgaaauaaauuuugcgaaaauaucauuucugucccacucccac

SEQ ID NO: 59653 - RNA, 62 nt, Staphylococcus aureus subsp. aureus Mu50
ucaagguguaguuagugauuaucauauacauaaaaauaagauauuugcuaaaaauacuuuga

SEQ ID NO: 59654 - RNA, 59 nt, Staphylococcus aureus subsp. aureus Mu50
ucaaauuacgugcuaaagcuugagauaucaauauuuauuggcgauagaguguaauuuga

SEQ ID NO: 59655 - RNA, 69 nt, Staphylococcus aureus subsp. aureus Mu50
ucacgcacgugaugugauugaauuuaaacauuuagaaauagauaaugaugcacaucgcguacuugcuga

SEQ ID NO: 59656 - RNA, 60 nt, Staphylococcus aureus subsp. aureus Mu50
uaucugccguuugauuucagaagaacgucuauaucguuuuauugaucgacacgguaagug

SEQ ID NO: 59657 - RNA, 70 nt, Staphylococcus aureus subsp. aureus Mu50
uaugcugugaaguuauuaaaucauuugagacauaaugguauuaaagcagauaaagacuacuuacagcgua

SEQ ID NO: 59658 - RNA, 68 nt, Staphylococcus aureus subsp. aureus Mu50
uauuaugaacgaaacagacuuacaaggccuauuauuuugguuaaguggcuccguuucauuacguaaua

SEQ ID NO: 59659 - RNA, 87 nt, Staphylococcus aureus subsp. aureus Mu50
ucaaaaauguugauaaaucaaggugugacguggguucacacauuuguuaaaauuauguguacauuuugugacuaauagcguuuuuga

SEQ ID NO: 59660 - RNA, 62 nt, Staphylococcus aureus subsp. aureus Mu50
uagauuuuauauaaaaagaagaucccucaaucgaggggucuuuuuuuaauguguaaauuuug

SEQ ID NO: 59661 - RNA, 59 nt, Staphylococcus aureus subsp. aureus Mu50
uacuuauuuuaacaucuagcgguacaagcgucuuggaggcuaguauguugaacauugua

SEQ ID NO: 59662 - RNA, 94 nt, Staphylococcus aureus subsp. aureus Mu50
uagaggugcuuugauuuuauugaagcaucaaauuaucccuuuuuucucagugggagacuuugauucagucaguaaagaagaacgccaacuucua

SEQ ID NO: 59663 - RNA, 92 nt, Staphylococcus aureus subsp. aureus Mu50
uagcuacauuuggaugcucauaauagauucuauuuuuaaauuggucuguuacuucuuuaagguuagagucauuuggaucugcauaguagcua

SEQ ID NO: 59664 - RNA, 64 nt, Staphylococcus aureus subsp. aureus Mu50
uagcuaugaccauaugccauguuagcauaugcgcuaugauccacauugggcauaaucacagcua

SEQ ID NO: 59665 - RNA, 67 nt, Staphylococcus aureus subsp. aureus Mu50
uauaaauagagaacagcaguaagacgauuucaaugagaagcugucuuacugcuguuuuuagguuaua

SEQ ID NO: 59666 - RNA, 65 nt, Staphylococcus aureus subsp. aureus Mu50
uaguagcuggcaaggaaaugaaauugucuuacauaaagacauuaauauuucaauugcuguugcug

SEQ ID NO: 59667 - RNA, 105 nt, Staphylococcus aureus subsp. aureus Mu50
uaucuacuauaacaaguacgcuaauuaacuuuguuaauagaguuauucaaggauucguuaauguuguaaacaaaguuagucaagguaugacaaaugcaguaaaua

SEQ ID NO: 59668 - RNA, 59 nt, Staphylococcus aureus subsp. aureus Mu50
ucaucaacguuuuauggcacagcuugauuuuggcggugugccauuugaaaauguuauga

SEQ ID NO: 59669 - RNA, 68 nt, Staphylococcus aureus subsp. aureus Mu50
ucauuaaugucuacguaugaaucuagcuaggacauucccuagcguuugaaucacuuggacaauaauga

SEQ ID NO: 59670 - RNA, 61 nt, Staphylococcus aureus subsp. aureus Mu50
ucgcugcaucguauaguuguugugcaaguucucuuguuggugcaacuacgauugcuugugg

SEQ ID NO: 59671 - RNA, 72 nt, Staphylococcus aureus subsp. aureus Mu50
ucguagaaaaugagagcccccuuuaccacaacauguaaaugcauauugugaaaagggggcuuuuauuuauga

SEQ ID NO: 59672 - RNA, 67 nt, Staphylococcus aureus subsp. aureus Mu50
ucggcauuuuaauuguaauauugcgcuucacacagaaguuauaaacaauaacaguuacaaaugcuga

SEQ ID NO: 59673 - RNA, 68 nt, Staphylococcus aureus subsp. aureus Mu50
ugaacgccaaaugcugucgucuacuuuuaaauuuucaauacuuagagguaucucauauuuggccauca

SEQ ID NO: 59674 - RNA, 55 nt, Staphylococcus aureus subsp. aureus Mu50
ugaacaaccgggcagaaugaaaaucaaaacgauuuuuacucuguccgguuuuuua

SEQ ID NO: 59675 - RNA, 85 nt, Staphylococcus aureus subsp. aureus Mu50
ugcaccuaacgccaaaauuguacauguagauauugauccuucagaaaucaauaaaguuauucauguagauuuagguauuauugca

SEQ ID NO: 59676 - RNA, 58 nt, Staphylococcus aureus subsp. aureus Mu50
ugcaaaagcauugaauaaaacugucauagcugaugacaguggacuagaaguuuuugca

SEQ ID NO: 59677 - RNA, 66 nt, Staphylococcus aureus subsp. aureus Mu50
ugauugguggguuuuucuucaaguaguccaucauauauuuucuagcuaaaaggaaaccuccaauua

SEQ ID NO: 59678 - RNA, 63 nt, Staphylococcus aureus subsp. aureus Mu50
ugccaaugauugaccgcuuccauaugcacaacaacaauuugcgcaaguggcaauguauuagca

SEQ ID NO: 59679 - RNA, 66 nt, Staphylococcus aureus subsp. aureus Mu50
ugccauagcguuugaguugcgaaaacauguucaacuucacuuguuccaauuccaaaugcaauagca

SEQ ID NO: 59680 - RNA, 89 nt, Staphylococcus aureus subsp. aureus Mu50
uguuuaaugcauucaauuggucgaugucauguuuaccauuuguuuuagcaagugcuacacguucaucaccauuuaaugcuuguuuugca

SEQ ID NO: 59681 - RNA, 113 nt, Staphylococcus aureus subsp. aureus Mu50
uguuauuguuuuggcgugucucccgauaagcguuguaugaggcaaugauuguuguaauucauaggcaauaguuguaccgacagcgccugggccgauaaucgcaacugauaaca

SEQ ID NO: 59682 - RNA, 59 nt, Staphylococcus aureus subsp. aureus Mu50
ugucaucauuggaggaggcagugcagguucuguacuagguaaucgucugagugaagaua

SEQ ID NO: 59683 - RNA, 57 nt, Staphylococcus aureus subsp. aureus Mu50
uguauugucagaaggugucauuaaaguaauggcuaagaugggaauuucgacagugca

SEQ ID NO: 59684 - RNA, 118 nt, Staphylococcus aureus subsp. aureus Mu50
ugucgcaaacuuuucuuucaauaucguugauagugguauugaaucugcuguagcaaaagaaaucgauguuaaauugguagaugaugcuauuacgagaauuuuaaaagauaacgcgaca

SEQ ID NO: 59685 - RNA, 82 nt, Staphylococcus aureus subsp. aureus Mu50
uguauauugaaugucauguuaaauaaaguuauauuuuacuaaaugaaauauaaaauuguuugaggugauuucucgguguaua

SEQ ID NO: 59686 - RNA, 55 nt, Staphylococcus aureus subsp. aureus Mu50
uggggugggacgacgaaauaaauuuugcgaaaauaucauuucugucccacuccca

SEQ ID NO: 59687 - RNA, 76 nt, Staphylococcus aureus subsp. aureus Mu50
uucacucagguuuaacauuauuacaaaucccugaaggcguugacugggauggcgaaguaguuaaaguuguaguggg

SEQ ID NO: 59688 - RNA, 64 nt, Staphylococcus aureus subsp. aureus Mu50
uuaguauucauauaaauagucuuuaaauagaaauaggagggagacauuuaaugauaaauacuga

SEQ ID NO: 59689 - RNA, 73 nt, Staphylococcus aureus subsp. aureus Mu50
uuauuaauuaagaucaguugaguaguuguguuuauugauuuauaugaaacuacucauuugaagccguugauga

SEQ ID NO: 59690 - RNA, 105 nt, Staphylococcus aureus subsp. aureus Mu50
uuacguacgacacgaugaucuugaacuucuugugguugauguaagacauaauucuuugcaucuuuuaaucgaccuugagaaaaaagauauuggaauaguauuuga

SEQ ID NO: 59691 - RNA, 87 nt, Staphylococcus aureus subsp. aureus Mu50
uuaaaaaaccugaaacaaauuaguuugauaugcucucuucaaaguagauauugaauggaguauaucagcuuguuucagguuuuauga

SEQ ID NO: 59692 - RNA, 70 nt, Staphylococcus aureus subsp. aureus Mu50
uucauaaaggcacgcauacuuuguagucaguuaucuguucugacauauaaagcgugcgugcuuuuuugaa

SEQ ID NO: 59693 - RNA, 60 nt, Staphylococcus aureus subsp. aureus Mu50
guaguugacugaacgaaaaugcgcuuguaacaagcuuuuuucaauucuagucaaccuugc

SEQ ID NO: 59694 - RNA, 66 nt, Staphylococcus aureus subsp. aureus Mu50
gucaaaagaaaacagcaguaaaaucauuccuaauuuggaaucaucuuacugcuguuuguuguugau

SEQ ID NO: 59695 - RNA, 130 nt, Staphylococcus aureus subsp. aureus Mu50
guauuuaaggcgaauauuacggauagacgcaaauggagagacaaguuuagauugccauauuuacuugguaaggccgauuauauuuuuguugaugauuuccauccauuaauuuauacgguucgcuuuagac

SEQ ID NO: 59696 - RNA, 83 nt, Staphylococcus aureus subsp. aureus Mu50
guauuguaaucaucugccugugcauguggcaucucuuguguuaagcgaauuaaugacgaugccacuguauucugacucaauac

SEQ ID NO: 59697 - RNA, 80 nt, Staphylococcus aureus subsp. aureus Mu50
guagguacugcuucaauuuuaguagggacaacauugauuuuuggguuaaguggucaugaagcuaaagcggcagaacauac

SEQ ID NO: 59698 - RNA, 124 nt, Staphylococcus aureus subsp. aureus Mu50
ggugauuacauuacugggacuuuccaaguuaaagauuuaccgaaugcgaauccuaaaucaaaugucauuccaaaagguaaauauuuaguucuuggagauaaucgugaaguaaguaaagauagcc

SEQ ID NO: 59699 - RNA, 86 nt, Staphylococcus aureus subsp. aureus Mu50
gguucuguuuacaaucgugauaauguugaacucguuguuaugcaaacaacagcuggugagauaggugucaugaguggacauauucc

SEQ ID NO: 59700 - RNA, 55 nt, Staphylococcus aureus subsp. aureus Mu50
gugugggauugcauuguucacuauugauuuccuaggaacaaaaccaguugcacau

SEQ ID NO: 59701 - RNA, 93 nt, Staphylococcus aureus subsp. aureus Mu50
guucuuauuuauugauuucuuugauacagcugguacauuaguagcuguugcuacucaagcagguauuaugaaagauaauaaauuaccaagagc

SEQ ID NO: 59702 - RNA, 82 nt, Staphylococcus aureus subsp. aureus Mu50
gucuucgucuguguuguaaauguuuuaccuuucgcuuuaccugaagcugaaaugguaauaucuuuauuuuguggauauggac

SEQ ID NO: 59703 - RNA, 90 nt, Staphylococcus aureus subsp. aureus Mu50
gugauacaauuauuuuugcaucaccaguguauugguauagcauuucagcaccauugaaagcauuuaucgaacauuggucagaaacauuac

SEQ ID NO: 59704 - RNA, 70 nt, Staphylococcus aureus subsp. aureus Mu50
gugauggcgaacgcccugaagaacuaugugucuuuucgauauaguuuaaaucuucaagcuguuucaucuc

SEQ ID NO: 59705 - RNA, 73 nt, Staphylococcus aureus subsp. aureus Mu50
gggugaaguuuuagaaauugucaaugaugaagaagcaauuguucaaaugggaauuauuaaaaugaaguuaccu

SEQ ID NO: 59706 - RNA, 73 nt, Staphylococcus aureus subsp. aureus Mu50
gguaaaaccuguugauacaacuggggcaggggaugcuuuuauuggugcaguuauuagcaggauuuuagcaacc

SEQ ID NO: 59707 - RNA, 71 nt, Staphylococcus aureus subsp. aureus Mu50
ggucagcauuguaaugaucugaaauaaagacaacauugccaccuuguuucacauaguuaacaauugcugcc

SEQ ID NO: 59708 - RNA, 76 nt, Staphylococcus aureus subsp. aureus Mu50
ggcuguauucgaauaaauuuuucaucaacuaguauucggggggaauaaaguauauggaaauuuuacguauagagcc

SEQ ID NO: 59709 - RNA, 83 nt, Staphylococcus aureus subsp. aureus Mu50
gggagaaucuaaucaagauauuguugauauggcauuugcuuuaaaagaaauggaugccgacaguauuccgauuaauuuuuugc

SEQ ID NO: 59710 - RNA, 65 nt, Staphylococcus aureus subsp. aureus Mu50
ggcaguaguugacugaaugaaaaugcgcuuguaacaagcuuuuuucaauucuagucaaccuugcc

SEQ ID NO: 59711 - RNA, 72 nt, Staphylococcus aureus subsp. aureus Mu50
ggaugcauauauauauagauuaaaccgcacuucuauauuaauagaaagugcgguuauuuauacagugaaucu

SEQ ID NO: 59712 - RNA, 68 nt, Staphylococcus aureus subsp. aureus Mu50
ggauacagaaauguagcuaacauuuucccaauaaauguugaaagaaaugauauaguuacagcuguucc

SEQ ID NO: 59713 - RNA, 79 nt, Staphylococcus aureus subsp. aureus Mu50
uuuuccucuucaguagcaggcgguugcauugauucuuugauauaugcaauuuccgcuucgcuauccaaucuugggaaaa

SEQ ID NO: 59714 - RNA, 56 nt, Staphylococcus aureus subsp. aureus Mu50
uuuguacaaucauaaacugguguccuguuuuaagggcaucaguuuuuuuauacgag

SEQ ID NO: 59715 - RNA, 76 nt, Staphylococcus aureus subsp. aureus Mu50
uugucuugaugcaugcgcuaggcgucgauuuuucagaaauugaggcggaauuagcgcguagacaucauaagcgcaa

SEQ ID NO: 59716 - RNA, 80 nt, Staphylococcus aureus subsp. aureus Mu50
uuggucacuaaaucauaaguggauuguaauuauauuaaguacauuaauuuugguugcaacuauuguauuuggaggaccga

SEQ ID NO: 59717 - RNA, 84 nt, Staphylococcus aureus subsp. aureus Mu50
uugaucuuauuaaugauacauuagugucgauucguuuuagugugaaucaaaacguucauuuugaaguguuguuaguaaaauuag

SEQ ID NO: 59718 - RNA, 80 nt, Staphylococcus aureus subsp. aureus Mu50
uugcugaacaacuauacaauggacuuugguucucaccuuuaacugauagcuugaaauuauuuauugauaguacucagcaa

SEQ ID NO: 59719 - RNA, 77 nt, Staphylococcus aureus subsp. aureus Mu50
uuggaaugauucuaucuuuagcgauguguuuacgugaaagcuuaaaucaaccagaugcugcagaugaauuagaacaa

SEQ ID NO: 59720 - RNA, 67 nt, Streptococcus pneumoniae TIGR4
uuguuaaaccuuucgcuuuucaugguaggauggcucucugucauuuuacuugaaagugauuuggcag

SEQ ID NO: 59721 - RNA, 93 nt, Streptococcus pneumoniae TIGR4
gggacaggagacuugguuggagccuuaacagcuguuuuucucagccaaggaaagacugguuuugaagcuucuugcuuagcagucucuuaucuc

SEQ ID NO: 59722 - RNA, 71 nt, Streptococcus pneumoniae TIGR4
gggcaggcuuuggaggagcuguucuuccaguauggacgguauuuauugauuaguucguccagagacugccc

SEQ ID NO: 59723 - RNA, 95 nt, Streptococcus pneumoniae TIGR4
gggauaauauuugugcguccgauaaagguugccacaaacucauuagcugguuuaugauagaguucuuuuggucggccgauuuguuggaucacccc

SEQ ID NO: 59724 - RNA, 60 nt, Streptococcus pneumoniae TIGR4
ggcuaggcaacugugguacuuggauuaagacaccagcuggugcuaacguugucauggacc

SEQ ID NO: 59725 - RNA, 59 nt, Streptococcus pneumoniae TIGR4
ggguagcuauacaggcuugcgaauugcgguagcaacugcuaagaccuuagcucacaccc

SEQ ID NO: 59726 - RNA, 60 nt, Streptococcus pneumoniae TIGR4
guguuggguugauggcaguaaccaagaucaauuuaccgacuggauugcucucaacugcac

SEQ ID NO: 59727 - RNA, 61 nt, Streptococcus pneumoniae TIGR4
gugggcccauaaucauuucugugcuaccucuaagcuccucacagaagcgaccauggcucac

SEQ ID NO: 59728 - RNA, 61 nt, Streptococcus pneumoniae TIGR4
gugggcauaaugcgcgugaggaauuacagcgagcgguuaugcaugcggaaauuauggcuau

SEQ ID NO: 59729 - RNA, 80 nt, Streptococcus pneumoniae TIGR4
gguuagcccgaaagauguucaguauagauuaggccacucuaauuuaaugaucacugaaaauacuuacuggcauacuaacc

SEQ ID NO: 59730 - RNA, 66 nt, Streptococcus pneumoniae TIGR4
gguugggaugucuuacagccgguucaucuuuuguggaucaacuugguaacggauaccuucccagcu

SEQ ID NO: 59731 - RNA, 58 nt, Streptococcus pneumoniae TIGR4
gguuguuuccuuuacgcguagcaauaaaaugacggcuacagacuuaaaagaaacagcu

SEQ ID NO: 59732 - RNA, 72 nt, Streptococcus pneumoniae TIGR4
ggucgacaacauagcaggucuaugcccuugagauaagauguuauaggcgaaauaggcugcuguugucuuacc

SEQ ID NO: 59733 - RNA, 78 nt, Streptococcus pneumoniae TIGR4
gucgacgcugaggcugacgcacugguacuugcugaggcugacgcacugguacuugcugaagccgacgcacuugucgac

SEQ ID NO: 59734 - RNA, 62 nt, Streptococcus pneumoniae TIGR4
guacuaggaagcucguuuaagguugaguuucuugcaaaucuuguuagcguucuuccuuuugc

SEQ ID NO: 59735 - RNA, 96 nt, Streptococcus pneumoniae TIGR4
uguuuuaaacguucaauccguucugagauagguggguggguauaaaagaguuuuuggaaccccccaccuuucuuaggaucauugauauaaagggca

SEQ ID NO: 59736 - RNA, 96 nt, Streptococcus pneumoniae TIGR4
uuagggagcgagcugaaaaugcugcuuuggaagaaauugcaguggcucucaauauucgccaagauuacuaccaaguagaaaccaguauuguccuaa

SEQ ID NO: 59737 - RNA, 93 nt, Streptococcus pneumoniae TIGR4
ugggcuacuugcucuuaaguuaugcaguggaguucguccuuuauauuauauuuuagggaugaguaucuauucuauauuaggguugauaguuca

SEQ ID NO: 59738 - RNA, 56 nt, Streptococcus pneumoniae TIGR4
uguggcgacaaacugaugcgaagggauuccuucaagcguucugaauuugcgccaua

SEQ ID NO: 59739 - RNA, 78 nt, Streptococcus pneumoniae TIGR4
uggaggacugaaaugaaaaauauaaaugggaaaaagguaacuauuuaugauauugcacguuuaucagguuuuucucca

SEQ ID NO: 59740 - RNA, 104 nt, Streptococcus pneumoniae TIGR4
uggaagcagucuuugcuagaauggcucauagcuuugaugagguuguuaauaaaucaguaguggcggcccagggcggagucguaaaugguaaagaauuguuuuca

SEQ ID NO: 59741 - RNA, 57 nt, Streptococcus pneumoniae TIGR4
ugaaaaauaugaagaaagugcguucccaggacaugggagcgcacuucgucauacuca

SEQ ID NO: 59742 - RNA, 112 nt, Streptococcus pneumoniae TIGR4
ugaugcugaaccuguguuagguaauuguuugccagcaggugacugguagguaacaucuugcauuguuccugcaguugcuugcggugcacuuguugucuuaggagcagcauua

SEQ ID NO: 59743 - RNA, 80 nt, Streptococcus pneumoniae TIGR4
ugagaaauuuuucggacucauugaggacaaucugaagcagguucauccucuuuuucagacugucuuuaaaaccuuucuca

SEQ ID NO: 59744 - RNA, 111 nt, Streptococcus pneumoniae TIGR4
ucuacaagauuucccucaguagccacacuugcuucagcuggagcuggaacuucuucugcuacagucucugcuggagcagauguaggagcuacuggacucgguguugcuaga

SEQ ID NO: 59745 - RNA, 91 nt, Streptococcus pneumoniae TIGR4
uccaaaauauugguuaagcgaugcagcuccccccuguccuaaaagauaaggacgguaggaacgauuguauuucucagcuaauaccgcagga

SEQ ID NO: 59746 - RNA, 63 nt, Streptococcus pneumoniae TIGR4
ucauaaguaaggagagcauucagauugaaccauuaacuagaaaagguuuuccuuaugccuuga

SEQ ID NO: 59747 - RNA, 64 nt, Streptococcus pneumoniae TIGR4
ucagucuuuaaaaagccuauuguaucaagcuuucuagcuuggucaguagguuuuuuaauuauga

SEQ ID NO: 59748 - RNA, 97 nt, Streptococcus pneumoniae TIGR4
uccuaguuuacuuuuugauuuuuauugaguauaagaggucuuuccuaagcaguuagaggagaauuuugcuauacugauacuaguaagugguaaagga

SEQ ID NO: 59749 - RNA, 84 nt, Streptococcus pneumoniae TIGR4
guuuagucauuggauaugucagcaucucagcuaagaugaaaucaucucaggaagcugcagaguugaugcuuuuaaaugcugaac

SEQ ID NO: 59750 - RNA, 57 nt, Streptococcus pneumoniae TIGR4
ggaaauagcuucugccuuauccaccuuuugaaucaagaggggcagaaugauauuucc

SEQ ID NO: 59751 - RNA, 111 nt, Streptococcus pneumoniae TIGR4
gcuuuagaaaaaaguagauccagagauuuauuuaaaaagaauacuggugucgguccucaucgagaugacauuucuuuuuauauaaaugggauggaugcuaguuucggaagc

SEQ ID NO: 59752 - RNA, 68 nt, Streptococcus pneumoniae TIGR4
gauauaaguuuugcuacuguugauuugccugauccagaugaaccgacaagugcguaggacuuuccuuc

SEQ ID NO: 59753 - RNA, 68 nt, Streptococcus pneumoniae TIGR4
gauaagcuagaacaguaucgagaacuggauuuaucugugucuaguuuucgauuagauguucuuuuauc

SEQ ID NO: 59754 - RNA, 63 nt, Streptococcus pneumoniae TIGR4
gauggcgguuacuugucaucauguuggacccucuacaaggcucaacaacaauugacugcuauu

SEQ ID NO: 59755 - RNA, 55 nt, Streptococcus pneumoniae TIGR4
ccuuccaagugauccagcucaugcuggcaaaucugagcugggaagccugucaagg

SEQ ID NO: 59756 - RNA, 72 nt, Streptococcus pneumoniae TIGR4
ccuucagcgcucuuuacaucgguuuagguuuucuuggaaaucauuucccaguaccagcugaagcgaugaagg

SEQ ID NO: 59757 - RNA, 67 nt, Streptococcus pneumoniae TIGR4
cgagaugucauggagaagaugagccguucccaaguuucggcucuaccaacuuuuucugagcagauug

SEQ ID NO: 59758 - RNA, 69 nt, Streptococcus pneumoniae TIGR4
cugcugggaugguggauccggauaagggugagauuuucuaugcugggccgcaaaucccuaacuacgcag

SEQ ID NO: 59759 - RNA, 67 nt, Streptococcus pneumoniae TIGR4
gacuuaccucuugcucuagcagucggagauuuugauucugugacggaagaagagcgacaggugauuc

SEQ ID NO: 59760 - RNA, 66 nt, Streptococcus pneumoniae TIGR4
gaccagguagccguccauugaaaucauugagccacaugcuuaaagguaaacaaggacgcuuccguc

SEQ ID NO: 59761 - RNA, 92 nt, Streptococcus pneumoniae TIGR4
gacgaccaguaggggugguagcgaguccaccuucagcuguuucacgaaaggcaguuggcaugcuugcuccuacuugguacauggcaucgauc

SEQ ID NO: 59762 - RNA, 80 nt, Streptococcus pneumoniae TIGR4
cuugccuuccaugcccuacucagcguaagauuucuauacuaguauagacgucuuggcggaguuagauaauggaauccaag

SEQ ID NO: 59763 - RNA, 74 nt, Streptococcus pneumoniae TIGR4
gaaaccaauggcuugcguugaauugugauuguuuggaugccuguaucauauaaucguaccaauccauugucuuc

SEQ ID NO: 59764 - RNA, 55 nt, Streptococcus pneumoniae TIGR4
gaacucuauuuucagacuugagcaucugcagcugcauuuggaaauaaaagaguuc

SEQ ID NO: 59765 - RNA, 69 nt, Streptococcus pneumoniae TIGR4
aagcuaguuggaacuucugcaagcuccggcuuaaucccaucaucucuccgagcuaaguucagcaagcuu

SEQ ID NO: 59766 - RNA, 55 nt, Streptococcus pneumoniae TIGR4
aaauggcgguucaggagcguuugaaaauugaucaggcugcuuugacacggcauuu

SEQ ID NO: 59767 - RNA, 60 nt, Streptococcus pneumoniae TIGR4
acccucucuaaggcagucgauuggucggaucgaucaacagcuguguuguuuggagauggu

SEQ ID NO: 59768 - RNA, 55 nt, Streptococcus pneumoniae TIGR4
acaauaacccacaaugaggcuggcacaaucugcccagccucauauccguuauugu

SEQ ID NO: 59769 - RNA, 100 nt, Streptococcus pneumoniae TIGR4
acaggaggaauugaugaugucgaugcuccuuucauggaacaaaucaagcaccaggcagaaauugccauggaagaagcagauguuaucguuuuugucgugu

SEQ ID NO: 59770 - RNA, 66 nt, Streptococcus pneumoniae TIGR4
acagcugguuugaggccuugaagagcggcuuuuagguuggcuacaagcgugucaagcucagcuugu

SEQ ID NO: 59771 - RNA, 55 nt, Streptococcus pneumoniae TIGR4
agggcagcuucaccugucaaaaguuuugcaaauucuucugauacuggagcuccuu

SEQ ID NO: 59772 - RNA, 55 nt, Streptococcus pneumoniae TIGR4
agaagccuuuaaucuccuuuauaaacaagguaaaguucgagauuuuggaguuucu

SEQ ID NO: 59773 - RNA, 68 nt, Streptococcus pneumoniae TIGR4
auuuuaggucacuugauagcuauauuuauuucaucagauuuaaacgcuuuagcuaugggugaugaaau

SEQ ID NO: 59774 - RNA, 83 nt, Streptococcus pneumoniae TIGR4
auuucuuuuuccuaggugauuuuaaugagguugaaauucaaaauguauuagaaucauuuggcuuuaaaggucgaaaaggagau

SEQ ID NO: 59775 - RNA, 104 nt, Streptococcus pneumoniae TIGR4
caagucuauugacuaaggaagcuucaggugaggacuuggcuuauaguguaaccaugaugcauggccaagaccacuuaaugacaacuaucuuguuaaaagauuug

SEQ ID NO: 59776 - RNA, 65 nt, Streptococcus pneumoniae TIGR4
cacuauauuucucaggauaagccuuggaaucaauuuucuguuggacgucuaagagaaguuuggug

SEQ ID NO: 59777 - RNA, 108 nt, Streptococcus pneumoniae TIGR4
aucauuguucuugcgaaugacaguugaaguugaaauagacaacugaugaucaaugucggucauagaagucuuuuuaauuagcuucugagcaaucuuuugguugaugau

SEQ ID NO: 59778 - RNA, 89 nt, Streptococcus pneumoniae TIGR4
cagguugcucaaagcacugcuuugagguuguagauaagacugacgaagucagucacauauauaauccaaggcgacguugacgcaguuug

SEQ ID NO: 59779 - RNA, 89 nt, Streptococcus pneumoniae TIGR4
cagguugcucaaaguacugcuuugagguuguagauagaacugacgaagucagucacauauauaauccaaggugacguugacgcgguuug

SEQ ID NO: 59780 - RNA, 56 nt, Streptococcus pneumoniae TIGR4
caucaucuuggcaguuuucaaagaaguauucuuggaaguauuugccagagauggug

SEQ ID NO: 59781 - RNA, 56 nt, Streptococcus pneumoniae TIGR4
cagcuggauagagcauucgccuucuaagcgaacggucgcagguucgaauccugcug

SEQ ID NO: 59782 - RNA, 58 nt, Streptococcus pneumoniae TIGR4
aaaaaaacuccguagucucuagcgcuauaaauccggcuagagauuacagaguuauuuu

SEQ ID NO: 59783 - RNA, 93 nt, Streptococcus pyogenes M1 GAS
auuguuccaaaguucugcaaaaugcgcagcagccauauccgcuucugauugacuagcuggguaggcuggcgucagauugagaaugguuccaau

SEQ ID NO: 59784 - RNA, 55 nt, Streptococcus pyogenes M1 GAS
aguuuagcuaguuuuucucaauacggcaugaccuugagacagaucuggcuugacu

SEQ ID NO: 59785 - RNA, 88 nt, Streptococcus pyogenes M1 GAS
gaagguaucuuugcugaauuagguggcugggaggcagaaagugaagcuucucaacuucuccaaaaucuaaauauuccagaagaccuuc

SEQ ID NO: 59786 - RNA, 57 nt, Streptococcus pyogenes M1 GAS
gcacaaaaccgacucuuguaguuugcuuuuuggcaacaaacaguagucgguuagugc

SEQ ID NO: 59787 - RNA, 58 nt, Streptococcus pyogenes M1 GAS
gagucagaagcauuuguucaauuggcagaaaugccuguggcagaaaccuucucggcuc

SEQ ID NO: 59788 - RNA, 61 nt, Streptococcus pyogenes M1 GAS
gcuaucuuuuggaaagccugccgugucuaaaaugccaaaguaggcauuuuuaggagaaggc

SEQ ID NO: 59789 - RNA, 87 nt, Streptococcus pyogenes M1 GAS
gcuauuuuuagcacucaggcaucuuacauuuugccuuauaccaagggcagccaauuucauguagauaaugccuacgcucaaaauggu

SEQ ID NO: 59790 - RNA, 68 nt, Streptococcus pyogenes M1 GAS
uaauccagcuuugcuuuaugguuuugaugcggguuauuuggcagaaaaugguccagcagauuugguua

SEQ ID NO: 59791 - RNA, 75 nt, Streptococcus pyogenes M1 GAS
ucaagguaucuucuagcaaauccucguccucaauguauuucuugagagagcuuguugagcuggauaauuucuuga

SEQ ID NO: 59792 - RNA, 64 nt, Streptococcus pyogenes M1 GAS
ugcuacuugcuuguugauuaacugaacagcuuuaccgacuucuuugauugaugaugcaaguaca

SEQ ID NO: 59793 - RNA, 65 nt, Streptococcus pyogenes M1 GAS
ugcaguaucaucacgcucugaaaaaguuggagaguauaucucagaagcuauggagcgugugggca

SEQ ID NO: 59794 - RNA, 63 nt, Streptococcus pyogenes M1 GAS
ugugccugugugauuuugcaagcuaauggcuccuauggcuugcaccguaucauauugguagca

SEQ ID NO: 59795 - RNA, 70 nt, Streptococcus pyogenes M1 GAS
uucaaaaauugcuaauaaucguccaaaaagauaggaacgauuuugauugguaugaucuagcaucggugaa

SEQ ID NO: 59796 - RNA, 78 nt, Streptococcus pyogenes M1 GAS
uugaacaagugucaacuaaaacagcuuauccugcaccagggaucgggaaaaauauuguauugguugauuuugguuuaa

SEQ ID NO: 59797 - RNA, 63 nt, Streptococcus pyogenes M1 GAS
gguuuugggaagggauuugcuagccuucauaaggcucaaaaaaugaccuucuucuuuuaaauc

SEQ ID NO: 59798 - RNA, 58 nt, Streptococcus pyogenes M1 GAS
ggagccacugaccuuugaccacuuagaagaaauuucugggaaagguuuucagggcuuc

SEQ ID NO: 59799 - RNA, 55 nt, Streptococcus pyogenes M1 GAS
ggagcugggcuagcugguucugaagcugccuaucagauugcuaagcgcgguaucc

SEQ ID NO: 59800 - RNA, 56 nt, Streptococcus pyogenes M1 GAS
uuggagugauugcacugcuguuugcauuaacauuuggaacagucaagucgguccaa

SEQ ID NO: 59801 - RNA, 90 nt, Streptococcus pyogenes M1 GAS
uuuuuuugacagguuuugugcacuguaaaauaggcaagguacucguugccuagucugucauuauggguuuguagggcauugucaaaaaaa

SEQ ID NO: 59802 - RNA, 59 nt, Treponema pallidum subsp. pallidum str. Nichols
uugagggucguuugacgcaacuugcucuagagagugagucugcgcgaaaggaucuugag

SEQ ID NO: 59803 - RNA, 67 nt, Treponema pallidum subsp. pallidum str. Nichols
ugcagcuguauccgaaauaccauuuuucuuucgaaagcuuaggagugcuauuuugggagcagcagcg

SEQ ID NO: 59804 - RNA, 73 nt, Treponema pallidum subsp. pallidum str. Nichols
ucuucuuguucgauugcaaacucaugcucggcaaggucaagcugcuggugagaguuuucaagcgaaaagagga

SEQ ID NO: 59805 - RNA, 97 nt, Treponema pallidum subsp. pallidum str. Nichols
ucgauaccagagaagcgugcaucgauugcguacaaaucuaggagcaaacuguaggccuuuuuugauucgguuuuguacguuccucugaugguaucga

SEQ ID NO: 59806 - RNA, 78 nt, Treponema pallidum subsp. pallidum str. Nichols
gcgcaagcauugcagugccagacugggugagcaccugauucuuaguguauucaaccauuugcuuugcgauguuugcgu

SEQ ID NO: 59807 - RNA, 86 nt, Treponema pallidum subsp. pallidum str. Nichols
gcguguauuauuuuaaugcagcgucuugcgcggaugagcguggucgcuucgaggaggcgcgugagcuguaucagaggagugcacgc

SEQ ID NO: 59808 - RNA, 57 nt, Treponema pallidum subsp. pallidum str. Nichols
gcgugaugcacgugauuuugugcugugguuuacccguaguaaauuugugcgucaugc

SEQ ID NO: 59809 - RNA, 62 nt, Treponema pallidum subsp. pallidum str. Nichols
gagucauuggagcgaacggggcagguaagucaacuuuuuuaaaaguccuuuccggugaacuc

SEQ ID NO: 59810 - RNA, 59 nt, Treponema pallidum subsp. pallidum str. Nichols
gaggaugaagcguaagguucauauuaggaagaggguguauggcacggcgguucgcccuc

SEQ ID NO: 59811 - RNA, 77 nt, Treponema pallidum subsp. pallidum str. Nichols
gaugucauguauguuuuaguucuguggagcgacaugcgcauagauccgcagguaugagccagcacauacaggauauc

SEQ ID NO: 59812 - RNA, 100 nt, Treponema pallidum subsp. pallidum str. Nichols
gccugagacgcccgacauagagcuucucgggcgguucguucguuccguucaacgguaccuauacgaagacgccucacggaagcucauugucguuucaggc

SEQ ID NO: 59813 - RNA, 69 nt, Treponema pallidum subsp. pallidum str. Nichols
gagaaguggcaguuuggauuugaaccacacgggaagguugugugguaccgacaccggagugccaugcuu

SEQ ID NO: 59814 - RNA, 77 nt, Treponema pallidum subsp. pallidum str. Nichols
cuagacuacggagauacaguuuuuacgucgguuuuugcacagaauacaagaacuaggagucugugucgcccguguag

SEQ ID NO: 59815 - RNA, 64 nt, Treponema pallidum subsp. pallidum str. Nichols
ccggugaugugaccgucucuacggugaaucuacccagugaagaaaugaaaggacgcaucauugg

SEQ ID NO: 59816 - RNA, 63 nt, Treponema pallidum subsp. pallidum str. Nichols
cgcugugguuccaucggacccuucugccaaggcagagggcacgcgugccguugggacaucgug

SEQ ID NO: 59817 - RNA, 66 nt, Treponema pallidum subsp. pallidum str. Nichols
cgcaaugccugccgcuccaagauaauacggcaccgaauauuccauuuuuggaucguaggcuaugcg

SEQ ID NO: 59818 - RNA, 78 nt, Treponema pallidum subsp. pallidum str. Nichols
auacugcucuggaaaagauucgcuucaaugaggagcucgugacucagucugaggcggccuucuuuucaaagguagugu

SEQ ID NO: 59819 - RNA, 59 nt, Treponema pallidum subsp. pallidum str. Nichols
aacaagcaaucguuacucuuuuaaaaacgcugaaagggcgugggaaaacguugcuuguu

SEQ ID NO: 59820 - RNA, 129 nt, Treponema pallidum subsp. pallidum str. Nichols
cagaauagacuugaccacacgguugccgguaucaaugucgcggcagagaacuugcaggcagcugagucucgcauccgcgacguggauauggcaaaagagaugguagacuacaccaagaaccagauucug

SEQ ID NO: 59821 - RNA, 65 nt, Treponema pallidum subsp. pallidum str. Nichols
caccguugguggggcuggacguggcguuccgugcggaaaauggcuuccugcuccaacugacggug

SEQ ID NO: 59822 - RNA, 82 nt, Treponema pallidum subsp. pallidum str. Nichols
auguaaugaaaauccuugccugaaagcugcacauacccgccggaauccgguucugcgguuaucagcaauuguuucauaauau

SEQ ID NO: 59823 - RNA, 61 nt, Treponema pallidum subsp. pallidum str. Nichols
cauaaucagcgcuaaaggaaaugccgcaaugauggcuaaacuuuucaggugcaugagugug

SEQ ID NO: 59824 - RNA, 61 nt, Treponema pallidum subsp. pallidum str. Nichols
cccccauggagacugcaccugagccgcgaggauuacguguugccauaguacucucaggggg

SEQ ID NO: 59825 - DNA, 22 bp, Homo sapiens
tagcttatcagactgatgttga

SEQ ID NO: 59826 - DNA, 22 bp, Homo sapiens
ttcacagtggctaagttctgca

SEQ ID NO: 59827 - DNA, 22 bp, Homo sapiens
aaagaattctccttttgggctt

SEQ ID NO: 59828 - DNA, 22 bp, Homo sapiens
aagtgctgttcgtgcaggtagt

SEQ ID NO: 59829 - DNA, 22 bp, Homo sapiens
tcaagtaatccaggataggctg

SEQ ID NO: 59830 - DNA, 22 bp, Homo sapiens
aacggaatcccaaaagcagctg

SEQ ID NO: 59831 - DNA, 22 bp, Homo sapiens
ggcaagatgctggcatagctgt

SEQ ID NO: 59832 - DNA, 22 bp, Homo sapiens
tattgcacttgtcccggcctgt

SEQ ID NO: 59833 - DNA, 22 bp, Homo sapiens
atcacattgccagggattacca

SEQ ID NO: 59834 - DNA, 22 bp, Homo sapiens
gaagtttgaagcctgttgttca

SEQ ID NO: 59835 - DNA, 22 bp, Homo sapiens
cactgcactccagcctgggcaa

SEQ ID NO: 59836 - DNA, 22 bp, Homo sapiens
taggtagtttcctgttgttggg

SEQ ID NO: 59837 - DNA, 22 bp, Homo sapiens
tcacagtgaaccggtctctttc

SEQ ID NO: 59838 - DNA, 22 bp, Homo sapiens
taaggtgcatctagtgcagtta

SEQ ID NO: 59839 - DNA, 22 bp, Homo sapiens
ctagactgaagctccttgagga

SEQ ID NO: 59840 - DNA, 22 bp, Homo sapiens
taatactgccgggtaatgatgg

SEQ ID NO: 59841 - DNA, 22 bp, Homo sapiens
tagcagcacataatggtttgaa

SEQ ID NO: 59842 - DNA, 22 bp, Homo sapiens
aaagtgctcatagtgcaggtag

SEQ ID NO: 59843 - DNA, 22 bp, Homo sapiens
tttccacagcggccaattcttc

SEQ ID NO: 59844 - DNA, 22 bp, Homo sapiens
agctgccagttgaagaacattt

SEQ ID NO: 59845 - DNA, 22 bp, Homo sapiens
aagttaagagctcccaggcctg

SEQ ID NO: 59846 - DNA, 22 bp, Homo sapiens
actgcactccagcctgggcaac

SEQ ID NO: 59847 - DNA, 22 bp, Homo sapiens
gtgttccaggaagtcgtcttga

SEQ ID NO: 59848 - DNA, 22 bp, Homo sapiens
tcaagctcattcctctaacctc

SEQ ID NO: 59849 - DNA, 22 bp, Homo sapiens
cattgcactccagcctgggcaa

SEQ ID NO: 59850 - DNA, 22 bp, Homo sapiens
acatgatctcctcactctagga

SEQ ID NO: 59851 - DNA, 22 bp, Homo sapiens
aattgcttgaacccaggaagtg

SEQ ID NO: 59852 - DNA, 22 bp, Homo sapiens
tgtttaagtagcttatttatct

SEQ ID NO: 59853 - DNA, 22 bp, Homo sapiens
tctaagagaaaggaagttcaga

SEQ ID NO: 59854 - DNA, 22 bp, Homo sapiens
gaaggcagtaggttgtatagtt

SEQ ID NO: 59855 - DNA, 22 bp, Homo sapiens
atcacattgccagtgattaccc

SEQ ID NO: 59856 - DNA, 22 bp, Homo sapiens
ttggagtaattcagtataggtt

SEQ ID NO: 59857 - DNA, 22 bp, Homo sapiens
agtagacagtggcaacatagtc

SEQ ID NO: 59858 - DNA, 22 bp, Homo sapiens
ctagcctgtttgtcctcacccc

SEQ ID NO: 59859 - DNA, 20 bp, Homo sapiens
tgaggtgggatcccgaggcc

SEQ ID NO: 59860 - DNA, 17 bp, Homo sapiens
tggctaggtaagggaag

SEQ ID NO: 59861 - DNA, 23 bp, Homo sapiens
aatcatcattattttgaagttta

SEQ ID NO: 59862 - DNA, 17 bp, Homo sapiens
taaggcatttttatggt

SEQ ID NO: 59863 - DNA, 22 bp, Homo sapiens
gctgttgttaagggcacttggg

SEQ ID NO: 59864 - DNA, 22 bp, Homo sapiens
ttcatgggagcaggtggtacag

SEQ ID NO: 59865 - DNA, 22 bp, Homo sapiens
actgcactccagtctgggtgac

SEQ ID NO: 59866 - DNA, 22 bp, Homo sapiens
tcactgcaacctctgcctcccg

SEQ ID NO: 59867 - DNA, 22 bp, Homo sapiens
cagatcacatccatccgtcacc

SEQ ID NO: 59868 - DNA, 22 bp, Homo sapiens
gcactcaagcctgggttacaga

SEQ ID NO: 59869 - DNA, 22 bp, Homo sapiens
agagagtggcaggtctgttcct

SEQ ID NO: 59870 - DNA, 18 bp, Homo sapiens
gatgaggcagcacttggg

SEQ ID NO: 59871 - DNA, 22 bp, Homo sapiens
tgaggtgggagaattgcttgaa

SEQ ID NO: 59872 - DNA, 22 bp, Homo sapiens
catgtaatcccagctactcagg

SEQ ID NO: 59873 - DNA, 22 bp, Homo sapiens
tagcaccatttgaaatcggtta

SEQ ID NO: 59874 - DNA, 22 bp, Homo sapiens
cagtgcaatgatgaaagggcat

SEQ ID NO: 59875 - DNA, 22 bp, Homo sapiens
tgtaaacatccttgactggaag

SEQ ID NO: 59876 - DNA, 87 bp, Homo sapiens
cccgtgaggaacagtggcgggattgtcccagggccccttccagcagggggacctcctgacttgagagtccccaaagccttcccaggg

SEQ ID NO: 59877 - DNA, 90 bp, Homo sapiens
ctccacctgtttgctagcataacaggcgtgaaggcggcagtgtcgccggcgtccttccgcggaagcccagtgtgtgcagacagcacgggg

SEQ ID NO: 59878 - DNA, 60 bp, Homo sapiens
tgggttcctggcatgctgatttgtgacttaagattaaaatcacattgccagggattacca

SEQ ID NO: 59879 - DNA, 126 bp, Homo sapiens
ggtcgcgctcactgcagattggagaacaggtgcatctcgtagctcttctttggaaaacaaaagaagccaccagctgaggaagatgctcaccggtcaccgtccctttatttatgcccagcgatgacc

SEQ ID NO: 59880 - DNA, 74 bp, Homo sapiens
aggtgcaggagcttagctgattggtgaacagtgattggtttccgctttgttcacagtggctaagttctgcacct

SEQ ID NO: 59881 - DNA, 88 bp, Homo sapiens
ctctaacaaggtgcaggagcttagctgattggtgaacagtgattggtttccgctttgttcacagtggctaagttctgcacctgaagag

SEQ ID NO: 59882 - DNA, 81 bp, Homo sapiens
tggggacagttaagttggagccgctggggcagaggccgttgctgacgggccggccgctgctgcacagtcagcttgggtgcg

SEQ ID NO: 59883 - DNA, 80 bp, Homo sapiens
ggtcaaatgtattgaaagttgcaaaaattcttcttacaaacataaagtgtgctgaatccactacgtaaaccaaaatcaaa

SEQ ID NO: 59884 - DNA, 82 bp, Homo sapiens
ggctgtgagcggggcggggcggggctttcggaggagctcctgttgttctgggcgcggtgaactctctcttgtatttgcagtc

SEQ ID NO: 59885 - DNA, 68 bp, Homo sapiens
ctccggtgcctactgagctgatatcagttctcattttacacactggctcagttcagcaggaacaggag

SEQ ID NO: 59886 - DNA, 86 bp, Homo sapiens
tagcagctattgtgtacgcaaagcctgagtacagcctgctggtgtcatggccacgtgtgagcaggccagcgtcacacggctcgctg

SEQ ID NO: 59887 - DNA, 705 bp, Homo sapiens
cccttattagaggattctgctcatgccagggtgaggtagtaagttgtattgttgtggggtagggatattaggccccaattagaagataactatacaacttactactttccctggtgtgtggcatattcacacttagtcttagcagtgttgcctccatcagacaaagttgtagatgttccttggataatttggactggaagaaaagagacatggaaggggacagatggtgtttagggtgaggcagatgtcattataaagtgacttgtctttcattaattggagcatataattattttacctttgggcatgaactcattttgctattcttcaactgtgtaatgattgcattttattagtaatagaacaggaatgtgtgcaagggaatggaaagcatactttaagaattttgggccaggcgcggtggttcatgcctgtaatcccagcatttttgggaggccgaggcgggtggatcacctgaggtcaggagttcgagaccaacctggccaacacggcgaaaccccgcctctactcaaatacaaaaattagccaggcttggtgacactcgcctgtggtcccagctactcaggaggctgaggcaggagaattgcttgaacccaggaagtggaggcttcagtgagctgagaacacgccactgcactccagtcctgggcaacagagcaagactctgtctcaggaaaaaaaaag

SEQ ID NO: 59888 - DNA, 18 bp, Homo sapiens
tttaaccgcatccttctc

SEQ ID NO: 59889 - DNA, 20 bp, Homo sapiens
tactaatacgactcactaaa

SEQ ID NO: 59890 - DNA, 30 bp, Homo sapiens
gactagctggaattcaaggatgcggttaaa

SEQ ID NO: 59891 - DNA, 30 bp, Homo sapiens
cagccaacgctgcagatacgactcactaaa

SEQ ID NO: 59892 - DNA, 50 bp, Homo sapiens
  misc_feature (50)..(50): n is a, c, g or t
  misc_feature (33)..(33): n=i
  misc_feature (37)..(38): n=i
  misc_feature (42)..(43): n=i
  misc_feature (47)..(48): n=i
aattaaccctcactaaaggctgcaggtgcaggngggnngggnngggnngn

SEQ ID NO: 59893 - DNA, 20 bp, Homo sapiens
ggaattcaaggatgcggtta

SEQ ID NO: 59894 - DNA, 10 bp, Homo sapiens
  misc_feature (3)..(4): n is a, c, g or t
  misc_feature (8)..(9): n is a, c, g or t
ggnngggnng

SEQ ID NO: 59895 - DNA, 12 bp, Homo sapiens
tttaaccgcatc

SEQ ID NO: 59896 - DNA, 12 bp, Homo sapiens
cgactcactaaa

SEQ ID NO: 59897 - DNA, 40 bp, Homo sapiens
taatacgactcactataggcccttattagaggattctgct

SEQ ID NO: 59898 - DNA, 41 bp, Homo sapiens
aattaaccctcactaaaggtttttttttcctgagacagagt

SEQ ID NO: 59899 - DNA, 42 bp, Homo sapiens
taatacgactcactatagggtgaggtagtaagttgtattgtt

SEQ ID NO: 59900 - DNA, 41 bp, Homo sapiens
aattaaccctcactaaagggaaagtagtaagttgtatagtt

SEQ ID NO: 59901 - DNA, 20 bp, Homo sapiens
gaggcaggagaattgcttga

SEQ ID NO: 59902 - DNA, 39 bp, Homo sapiens
aattaaccctcactaaaggcctgagacagagtcttgctc
